United States Patent 7,820,447 (COMPOSITIONS AND METHODS FOR CANCER) - sequence listing, part 5

SEQ ID NO: 1544 - DNA, 96588 bp, Homo sapiens
acatcttgggctcctttttaattacatcctacctaatataaaaactgtaaaggtatctctgtatacctataccatcttgtagaaaatagctatatatttcttaaaatttgtaatttgatttgaatcctcatattttgaagagacttgaagcttaacaagagcttattttttaaaaaacatattctgtattttaaaatttctaattactattttaaataatgaaaatagctgtaatttatcaaaggcctgatcaatgttaggataattctcatgaagtcatttattatcataattccacaaggtagacattttaagtttgcaggaacctgagactaggaaaaaattgtccaaaatcttatgcctaataacagattctaaagcctgtctttatgtctaatagccaaggccatgggaaattacacttaatcttttcctgccctgattcttctaaaaagtgtgtgggtcatgtgcaggccattgcaccaagttggttgtcagggggaggtgggtatgccctgttgccaagagcagccaacaacaaaggcagcagggcaaggttgcagcaaagaccaaggttgcaacatcaataactactgccagtggaaactagcccatgtgtcatacttggtatgtatatatctgttgccaataaccccaaagtagacagtgttttccttttagtcactgagtaatctagtcataaacaaaacagatttacttcatcggctgcttctttcatcatgggaaggaaaatgcccaaagttatgccacatatcgtctaagcataccttctttctaacaattaattttggctgccttctatgaatctgatattggtgccaaacattccctttcccacaagttcaagagtaatcaagaaaagttgacaccttctagtgtccacgtgggcttcttggtatttagggaccttggcaaattatttacagcttctttcagacgagccttccagagctttgtaagaataaacaaacttcaaaggtctccgaaggggaaaaactgtcctggctaagtctataatttaggctatctttagagagtacaactccataaagagagaggtccaagaaaccagcttcttttatacaattaactttttctttacttaattgtaaagactaaatgacaagtaggaaagtgcttttgcagaagcgtgggagtcttaaagctgtagaaggaagaaacactgtgcatgggagtaagtatgtgggtgggagttatagattactgctcttttgctagtctagaataactatgcataaacatctttatagtagtaacttgaacagaatcgttaaacttctattaaaggcacttgatacatcattcaaaataagcacaggttaccttatatccagaaacagaaaaaaatcattttacatccagccaaaaaagattttaaaagagcctttgatttttgacaaaacaagtgataataaaattaaatttttattttattttcaaatattaatccaaaagccgacatgctgtacttcttgaagttatcaaagataagctggctagctttgtctgtagatatcatacccttaaaagattaagcccaggaagtgaatgacagtaacaccaaagactgcaacagcaagagcatagtactaatgatcagtcagagatttcttccgaccctgcctttagaggctatgtgatggacaccttgccacttaacacaaatagtcactatttcatgcaactagtaatagaattctgtccttacaaatgaagaagaattcaatgtgcacatgtagtacaaatactgtgaagactttcaactataatgtgagacatttgaattcaataaaaaagggagagagcaataaaataattataattgtttatctgtttagattcaccagatacacactctcatttttctcattcactaaattttgcacatttatattatttacttagttgatcataattatttaccatttcatattcattgtccttgttatactgcatatttcaagaggcttcaggtctagtttttcttaccatgtagcctcagactctaggaaagactggaattatgccaggtgctcagtgactattgtagactggataggaaagttgatagcaataaggtttagaatgaaaatgcagcagtaactggtgagctggtgacctatggccagaaaagtttgaaaaaggaaaagaatgctccacattgtctaaaaacacattcattactgggagggctcgatggaatcaggccctgtcagcagttactcattgctaagcccattgcagaaacatgggcattcagatccatccaggtggggccaggagggtcaactggactgacggcacattcacgaaggccataaactaagatgtctagcattatcttcaaatgagtttcaagtgaggtatgttctgctaacttgtttgtgtttataatttaactatgttaatttattgaacgaatttataaaatatattgaatgtacagaatagcttttgttgaatacacataattacatgtatgagtatgtaactggtgaagatatgtatatcttcaaaaggaagtggccaaggacacactttatctctcagaggctctgatgtcactctcaagggggtgcgtataatcacaatttcttagcaagagacagggtatagaattttaaacaaacagcaaactaagcattttagaatatgtaggattctcctttgtgtgatcttaactctttgtcttatctgtttttaatcctatggaccactaatgcttacccggcataaagtgaaacatattttggttgcctaagaagcaccacttccaagcatgtgcatgacaaaatgtaccaccttgcaccaccagtttagctatccacagctagtcctaactccctcatttctagatgcatatgggcaccagcctacccaaatctaattctatatgagatcgagtttcctgcagataattctgtttctattgagccaaataaactttacttgccaaaggaaaaaatggaacaggtcaatggattgctacctattctggttaatttccatttcctaaactctagcttcttgcagagtttaggcaagaagctggcaaccttggctgcgctttgaaatcatctaaggggcttaaaaaagatacagacgcttggatgcccctcccagaaattttgatttaatttgtctgagttgcagccggcctatccaaaatgtagtcagggttaagaaccaccgccctagtttcagtctcctcattatgagcatggggtcataattacctcacatacctcttgttttaagttcaaggagataatgtgtgaccttagagtccttaacactttcattactcctttgcttcatgaaagacaaataaaaaggaaggacatggggttggcaagtctgggaaggtgaggaggagggatccttctgcagagttcttccaatgagcagttcattagggttaacaagctatcctttgttaaagcaaacgctcttgagggattaagcctcattctcgccttagtgtgaatgactttaatcagataatctcctatcacctagttgaggatttgttaccgaaagcctaggggaggcaaagagagagagttgcaaggccagtttgggattcactgaggcaagccaaggaagcctcagcctctaggaaagaaacctgacatgtagtaagctttccataatgacagcatgaaaaatctgaacaacaaactttctcctcatgttgctaggacaatatttgttaaaagtgtttttctgatcaagcctcttgtctgtccaatagcctttcatgactttttttctgactttctttctgccatgaagctcttaacaagtatcaggtagttttaccatttgccagctgcttgggagtccgtgaggagcaaggccttgcccagtcctatcctccttgccatctgcttggcacatggtaagcacgcagggtttgttgaatttaactgaatggtttcatttgctacgctcttttccaactgtgatttttccctcacgtctgtccccaaccgctagactatgaacaccttgcaaaagacttaataacttctttatccccagtgccaagcacagcccttggcacataatcagcagtcaatgactatgtgttaaatgtattaaggaacaatagccagtgtactgatgcctaagttaagatattaaaattaatttatgactgtactgctcagttcccactcttttggacaaggcaaagaggaaagaagagaaaaagaaacagatatatgaaactcccaccatttattaatgggacaaatgttgttcttattcaaaggtctctttagaacatctttcgagacatgatttgaaggtaatttcaggaaactcagataggcaagaaggaataagaggagctaacaaaagatccacagagagaactcacacaatggaatgaaaagagagggatgtggaatatcatagaaaccaaaggaaaggaacctcaagaatacaatgagtaagtagatagatacagccaacatttaggaacattgacactgctattggcattgtcaaagattggtttacctttagaaataaataagacaatggccatattttttcatatttgttttctatatggaacagtgttactacgtagaaatgtttgggttacagtacataaaacagtttcactacgacatttatattaaaagccctattagatactatttttaaaagattgcaagggaattctgggctaaataacaacacagaattttatgaaatggtagaaagtgttttacaatattacatgtaattacatattataagcataaatagataatatgtcaattttgatcttctggctgtattctatatttatttttatatccgtttagtttattgaaagaccacgattgcatatttacttgtctttaacaacagtccatagtagaaggtacgcatacatcccaggtagagtgtttataaatatattacacattagacagatgaattcaggagcttggggtactggctgtgaaacactgtggggcaggaggcttgtcctcttgttagctgcaaggctttggtcaagggccaactctccagcttccattacctcatgaaaaatgaagattatatataaatgacatgggggaggtggcctttgttttataagattgtcttaaaagattaaatttggaaaagaaattgcatatatagtacaatattaactatgcttttaaaaatgcattggaaaagcctagaaggaaataaactgtaatacaaacagttccctatctctgggaactggaaacactgctgatatcaaaatattctaccttcactaatttcgaattttctatattgtgttgactccaaataataaataagtcacacacaaacaggcataccacatctcccttccctcaagttatgttatctcgaggatcatgagtcttatggcttctcttcaactctgagatgtaaggttctaaggtttgttgtaccccattgccgagggtcttcaaccaaatcacattccgctgctgggtccccagccatttgctgtctgttgcctcctagacagagcccacttttggtttgctgtcattctcagcagtggtggacttcatgcagtctcttctgagattagactatcagcctttacacagcagtcaagagttatctagttatctttgtgaaaacaaaatttagataatgttccatcaccccaccccacccctgcctctaacataatcaaacacttcaatggttcccagtgaggaaaagtatcatggttgtagctttgcattttgagtgtgattaatttgatggagattcattttttccctcttccttgactgtaagctccttgaggttaggtagtttttgttcaccattggctctctagccctaccatgaaccctggccttagggctcttgccatgcagtccccactgctttgaatgctctttccccagttatttctcacttcaccgagaaccttgcctgcatatgaccagctcagtcctccatcctgtttcacacaaccttctctcccaaatccccccaacctgctttatttcatagcgcttatctccatctgaaattacctcatatgtttatcttttattttttatttttgacttattttttgttgcttgtctccccctagtagaatgcaacccctttgagggaagtgatttatctgtgctgttcatttctgtaaccacagtacctagaataggagttagccatggctgatgctcaataaatgtttgtgaaatgaatagagtcattgtgtgaaaagtgttttctgtatggaaagaagaaagaaaggatgaaaaaatagaaagaataaaagaaggaaaaaatgaaagaaggaagaaacagaggaaggaagaactatactcttggaaatctcatgtagcacctccttacattaaactggggaaactgttaggcctattttagagcttcttcttgtccttattgtctttaagaaaaaaaaaaagacaatgaaaatgaatggcctgagagagtcagaagacactgatgtcagttctgctctgccatggtgccaagttccttaaataatgcactcctctggtttaacaagggaacaaggccagatgctctctaacattccattcaatgctaaaattctatgattttgaacttttaatttcaaaatgtatttgcttactgtctctctattgccagatcctaaaataatgatattgaagatacagattcaacttttaggtaaaataacttaattgagaaatgcataatatttaactgctttaaatttcataaacatttagtagcaaatatattgattttatatattttcacattcatgtgcaatatacgtgttatacatacaatatattgtattatatatcaaatatatacatagtatctattagaatacatatttttatttttaaataatgagcacaaagaaattgtgttgtgtatgaaatatataaaggtccttgaagataaactaaattcatgtaattctttctctcaagtatatgtattcaaatatctgaacaagtttgaattctacaaaagaaggtctcacctctctcctcaaccctgttgtgaagtttaatgtgataaatttaatgcatctacttaaacttgattctccatacaagaatgtttgcaacttttgattgccttttagagtcatcttctcttgaccatctatatttaaatattgattaggaagcacaggacatgagactaggttctggttttgacaccatctttcaatcaattatttttatcctggtataataaaaatagcattttaaaagagtatacctccttgagatatttttatttaggtgatttgtttgtgtgagagtgtgtgtgtgtgtgtgtgtgtgtgtgtgtgtgtgtcaggaaagacaagttatattgcagaggcagtgagagcttattgagctatgaatgtggtatgcagaagaagtaagtcacaattcacacaggcactcacacacttacataggtaccttaaatatccccattggactgaaaaagataaatgctgccattatctttatctttattattggtaaacaaggagctgacattatctataaaaaccatattccttaactgtatttttattgagattcattggtataattaaaacttgaatggactgaaatatttcaggaacctgcagtgaacactctttcctttatctgaaaatgtagtttatttcatctgaaattgttttctataatttccctctccacccataaatgaccttctttttatactcatggatatactcacttatgaacctgtagactatacacttcacagaaataggagaaaccataatgttctcctggcactgagggaatatcaatggtattctaaatgaggaactattaactttttattacaataatgattttttagtaatttccatagtttgaaatgtggttaggatgctactggcagttgaaagctgacaacatgattgaatagttttaacatgatctggtgtttgttacagtgctttaaaattttaaatattatcattcatgttataatgttatccagtgatagtcaattaggccaaatcagtggtaatttagtgttatatcacaatttatttggactcgagttatagattgaccattgctttgtgagttttcttagccattctgtttttctgtatctaatgtaaaataacattttttctccttttttatttaccaggatggttattctactgtttctaacattaaaggatcatccttgtatttctttgtattctgtcatggagtaaaaaacatgtctcatctcagtttccatttctcttttgctcccagaagtcccccctcctccagtgttgaagtagaaatataatttccccttttgcaccataagcaggttcaaaagtcctgtgtttcaccatgttgctccaaacagcaaattttctaacccacatgaaaaaagaacactacagttctaacttggaattctacaagggtttgagaacaattgaaaataaatttctaccactaggattagtccttagtggttcgcaggcattctaagcagaggggcatggaagctagctagggcaccaacctgctagcagatgcaaagtttgctctactaagaagttaggcctttaatatcacagacaatgggaggcaaaatgaagacataaaaaggcaagtagcaagcaattcagtaggctaagccagggatttgagagtctcccaaggctcctcccttcctcattccctgcatgagtcatttttccagtctgtccacacccattcacccctccatcccacactctcattcaccctccaagctgccgtcacaggaactttctgcaatacaagtccagactccatctctggcccttgctgcctaaactttcctagttcattagttttggcagtaaagttgagactcgttagatcaacacagacctacttttagtgtcatctcctgccactctcctgtactaccctaccctcgcttctcacagaaaggctgagaaggctggcagaccccttgtatataccctgctcctttcgttttctttgagacagggtcttttaatgtcacccaggctggtctcaaactcctggcctcaatcctccctccatggcctcccaaagtgctgggattacaggtgtgagccatgccatccagcctgccctgctcttttctcttctccacctggactctactcccttttgatcttgccaacttctacacacctttcaaggcaccagttaaatgtaaatcctccaggaacccttcctttgccatcctcagagccctcattggattgcttcccacatacagcacttatcccttatgcagaattaatcggtttgtctctcacctactagaggcgttatccttgagtgtagggactgtcttatccattcttgcatcactggcatagtaggcactaaatgtagttgctgaatgcttaataagaggaatggaagtcttcgtagcttggggtagatactaatgggcagatagaaagttcccatccctgttctctgagaaagtgtcagtgttcttttagtttgcttaaactgtgtgggtacttgagtccttttaaacgattaacgctgggaagaggcaccatttaattaattaatttgttctggaagggatcagtgtacaattttaactcagtgctttgtggatctagctaaaggtcaagaactaaagtcggctattagtgcctctggaagatatttctgcactttagcacctttctgatgtttttccttcacctcgagctggcctcactctcttcaacaaaaccgaacctgcaggaagaatgttgtaccatatccagcatttttgtcccaacaaacatgggacaaacgtttttcactagaatcatccttgaacaagttatccgaattccttacattcaaaggaaatcctgcccccagtctccaaaacttcatcacatcacagacgttcaggattctttccattcaaagcaaagccaagttacatcttatagcacccagtgaattatgatatggggctgcggtttatttgctctggcgacaatatggcttacttgccgtggaatatcccggtatttcagaagtaacatattatttttaaagagggagctttgctttctctaaatcacatggtgcaaagttgggaatacagtggcctgtaaattacaaatattatttacaaactagaaggaaagctgacatgtgtttgtgcctgtgtgacagtttcactaaggaattccaaaactgtggatagcctgttacttgagaaaaatacacggtggcagtcttgcagatgtttttcccgcctgttagccctccaggttcaaaaactgtttggtgcattttaaggcggcagtctcaccagatcgcaggattctagtctaattggcttctaaccttcaatctaaccttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggtaagtttccattttcacagtttccccgcgccgcttcattgttcggactccggcgggtctgcccgtggctgaaggaggaagtgcgaggaggtgctcgccggccgcggttctcccgggcaggggcgggccgctcgcggtagttggtttcgcgtccctcagcacctcctgcccgggggaaggcgggagggtgagccgcagccgctcctgcgcccttccctgccgcgggctctgcggacgctgtcacggcacagcccgcgcacggcttggcagcccagcgggacccagggagaaacaggggggcgagaagagaaacaggtgcgtgcaagtgtactcacaacttaatgacctttgtcgggggaaggtgtgagtccctctgagtcgagcggcgcgcgggtcttcccggcggctcccgcatccctggccccggggctgccatcccgcccggttttcatctgggccaaatatgtgcacgcaaaggttaattctctgcttgctacccataaattacgcatgacatgtttagctgggctgccttatatggagagtgctgtatttcaggccagtttgccttttgccaagtttacagggcggaagacgccctgtaggagagggctgcctcctccttttcttcttcttcttttttttttcatcgttttgtagtgcgtcactcaaaaactgtaagaaaagtaagtatagaagctctttgggtggagccgcagttggttgaattgctttcatgaaaggttgaaaagaatgaaaagtagttagtacttgggttctggtttttagacaaaagcaggacaaatatgtagccccccccccaacttttttttttttttttaaacggagccggaatctgttattggtagtaatgtgtcatgtgagaatactttgattccagagcctgtaacacgagcaggtatatggtggcgcttatgccttcccctcgcacagcactttacaactacaggggtgttgctgccagagtaatattgtattcttaaggctctctggggccgggagagtatgcggctgttgggattctggggtgtatttccgtggagtatgtctccccaggattaaagttaagaagctgccggaaaggttgttgccgctgacttcactttgtgtgcccaccagcacaggcacaagtcatagcagatggatggcaaactctgccatatactctgaggagtttcttaaattaatacgctaggagagaagtcataattaatgcttttagactttcgagccctctgcagcgtgctttgaaatactacaccggtggacactatgtcccttcctcctgggtttgaacacagtgtctgtttatacacagagggtgtttagtacctaagtattctataccagcacaagagagccactccacagttatctctctgtgtggattcctaagtgtgttggtgtttctccttgctgttgagataaaatattatcacccagagagaaaatgaaagttcaacgactgtaaaatttatcccaggaatgtgcagttcaatacttagaatgtcttagatgtagttatagatagaggcactgaataagttattttgtagcctgagaatgcacatcgctgtcacttgtatcttgctttcttaaagttggtgacaactaaggctaaacttctttagaaaacctaatgttctagtttttatctgttttgtgtatttgcatgggagttactttattattattattatattgttaggtcttctttgaaaatgtaggcatagcttttttagtcttatttgtttaatggggggtttccttgctgaagactacaaaagttgccttttgtgttttaaggaacaggttgggtcagcaacagaaaacctgttcatctataattatagtgtcacttaagacataataatcagatttcattattactaagagactcagaaaaacctcacatatgcctagtttaatttttttccttatgtaactgtgaacaaatttgtgtgtagatacacatcaagtgtggtactctgcgcagtcatgccaaagagaaactgaagtgttatatggtttgagatattattgcttgtgtttacatttccacatttgaggcaaagttagactccaagttgaattcattaaattttgattccaacattctgttcttcctttgggcacagaattcctatgaaatgaaacactgggttttgttccagaacaagaacagactaacccaaaatttctcctgggggaaaaaaaaagagtaaaattacatttctcattgaaaattgtatttctcattgaggaagggtgtgttactttattatataaaatgccttatcttcattataagaaaaaaatgcccttgcatttgtcactgttgccatacattaggcctgtatttgatagatctatatggaaacagagaataaataatcttgctgcaccttctggctttctgcttggtgatagatgtgcggattagagaacatctcaggtcttggttaggagaagctgaaaagaataggtgattgggtttttaaaattctgtatgcaaaggcattagggtgggtagtagatatgagagtcaaaagagtggaggaaagaagtgaaataggttcacgaagtgattggcccaaaataaaatcccatcaaccatatggatcatagagaatgtgacatagaaagattttaaagtgtatggtttttttaggccaaaaagcttcatatgtttggaaatctagaatgtgctgtccagtacagtagccacatgtggctgttgagcacttgaaatgtgtcttgtccagattgagaagtgtaaaatactaccggttttgaaaactttatatgaggggaagaaagtaaaacatctgattaatatttttatatttatgatatgttttaatgataatttttgatatattggttctaatagaagatcttactagattaacttcacctgtttcttttctctctctctctctctctctctctctctttcatggtgtctagaaaatataacaaatgtggctaacatcgtatttattttggacagtgttgttctaggataaagcaggaaaacaatattctgggagaaagcttaaagattttgctggtcaaaacaataaaattggcttattttattatacatagaaatacctcgtctttcttatccattgtaaccaaaatttgagaaaacacaccacctaacatctatttttatttcctcaaagctgctatttagtttagagatttgatggtgaggtagtaataatagagaaaaacttataattagagaatgagtcttaacacctctcaaaggccaaaatagagtatgattgttacttaggaacattttagagacactgtagttatcattgtcctgaagttaccaaacataaacgagtcactaaaattattttaaaatagagattttagtaaatagcaattatcttcaaatacttaatatgtgttttcttttgctagaactttctttagaaagttaaaaaaaaaaacccatatccaaagtcctgagcaaatgttaataaaagattgctgcattcataagaatgaaagatttttacctgcagataggagggtattgttttgaatattagcaaaggtgaaaatgtgtttctaacgtaacattatgggctctgaagaatttctatacatggagacactgtctttataatttgaacacattcttgagaaggcatctgactggtaaacaaagcacaatggcataggtcctggaaacattcctttcagatattttcataactgaagtacattttgccattcacagtgagtgttaagctgaaaaaaatgtggttcttttctagccatataaagtatgcttactattattttctcgaaggatgccaaaaaatgtaaaatggatgttgtggattcttcgtggggaggttagctagtttgtatatagagcctcaagaagagttgcctcagcttggtgccatcttgagtctgtcttccactagatgaggcatagcttccattagtgtcagtgcgtgtgtggagggtgaggggaagaatgatccccattaactttgtatattgtttctgatgagtcatggagcatattcactaatggttggagaattattgattgcaaggcagaggattcaagaagagctattggcatatggcattaactgtctctagacatattttttatttttaaatttgaggtagagaaatcggtttttacgtagtgtttttcatattataaaaaataaacgtttatataagcattacagatacatccttgaggaaaaaaatagtaaatacatggttatagttttctacatattaccagtttttttcataacagatccagaacatctctttcagataatcgttcatgtttttagagaggcatctcatcatatgtgcctgtgaaatctgtaaaaatatgtgtaacacacatcttgaaatatttgtgttaggagaattaagtcttacacatttggttctttttctactgtttttgattatgttctctaggttactatgattatcttttgttaaaacagttcaggaaatattaatctcaaaacgaaatgtagccatattggacagagtagagaattgcttttccacagagaccagttattccaaaaaggtgaagatgtttctgaaataatatcatgctcatatgctccaaaagaaaaaccatcatctcttttgacattcttttaggaaactgagagatgtatgttttatataccaaaagaggtgaataatagttgataaaggtatgcaaaatacatactcctgtgaagtgtgaacatacaatttgtatgtaacgcatgcatgagcatataactttccccaagacaatgccaatttattcaaatcacctgaatgttaaataatatcatactattaagaagaattgtggtaaatatgaaatctaaataccagtgatgatgtccatgctgatgtcaactccattccagtcctgctttagctaaattcacaaaatgaagagatgtctttctccaaagtagttttccaaaaatttgtatttgacactggattttttcctacgttttcacttttaaaagtttagaagctattaactaaaaatgaacttgttttagagagctaagaagattctagatttatggggacatatttagttctatgaaataagcattacgttgctgacttgaaatattattctatcatataaagttgatttataagtgaatacatattgtgaaaaaataccacagtagacttagtgaaatctaccaaacttaatcaagatagatatacgttgtcctcaaaaaaataagaatctggtagggaaaataagagcttcgaaaataactataaagtagaaagtgatatttaataaacaatggctgggtaacatggtatgaaagttcagataagggaaagtcttaagataactctgacttgacccacatacatgtaataaagggaacagtccttaaatgcataaataatgggaacaaaaggtattcagtatttttcagccttagcaaaatattattctgttaacgcagtattctattcagcaatggttccatattttccatatgtttatagataacattcagatatcgaattttcatatatgttttaattcatttatttatttcttttatctaggagaaatataatggtttccaaatgtcctatactagattattgatagattttgtcattagttttactattgaataccatgaaatatcagctgttgcagccactaaatagttacaaactgttggtactacagtttactagtcaatccatggttatatgcttgtgctatgctaaatataaaggattcaagatgaggacttaagcagttcatatttgtatttagaatattatcaaagatattttcttaacttgtctcagtattagaatttacagcccattttcagcttattgtatccagaaatttcaatcatatccaataatttatcagcatttgttgatgacagtaaaagtgacacattagcattttatttgtttctgtgttgtttgattacaacagtgacattttagcactctttgtggacggataactcttctagtagaaagaaagcaggagggtggtcaagctaagtgacagatacaaagagttggaggacatagggctttctgtgggtaagaaatggatgagaaaagctttatgtcactgactaggcttgcaattcagtattcccctatcaaaggcccccttactgatgtttctgtttaccagatcttggtttcaagatgccaggttctgaagagatacaccacgagttcttataaacactatatctaaatttggtttgaaagtctaatgtttggctgtgtgcagtggctcacacctgtaatcccagcactttgggaggccgaggcaggcagatcacgaggtcaggagattgaggccgtcttggccaacatggtgaaaccccgtctctactaaaatacaaaaaattagctgggcatggtggcgcatgcctgtaatcccagttacttgggagctgaggcagggggattgcttgaactcgggaggcggaggttgcagtgagctgagatcatgccactgcactccagtctggcaacagagcaagactcttgtctcaaaaaaaaaaaaaaaaaaaaaaaaaaggctaatgtttataccaggcaggtagaaaaacaaaaacggacctcattagaggatacatgaggtttctaaaagtggaactcctttgtaaatgtaagaagtgatatcaatattattattattttaatatacttattttgaagtaactaagtttttttgtttatttcttgaaagaaacaatagattggggaaaaaccatttactcttttcatgccctagtttctaaatctgtgacattataaaggtgtaaatatttatgaaaatagtagaagttgccactggctgtattcttttaagtaaggtatctcatttaatcttttctactgtaaagtagccgtaaagtaataagacttttaccttaaagatcatgactagaacaattttttcatttgcggagatatgaggcttgtcatttttattattccaatgttcatgtttttaaccaatttttcttgtcttgcctccactgattatatataaagaatagcgatgagaatatagctgtaattatgattactaacatctttgaatactttctgtgtgctaagctaaggtttataattaattcatttattcctcagaacaaccctatggtataggtactgttaatattctgattttacagataggggaactgaagcacagacaagtccaattaattgtgcaaaggtacttaattaataagtagcacaataaggagttgaaccaaggtagcccagctttagaatccatgctcctgtgtaaaagaataaaaacagattttaaaaatacttattttggatgctgataggagcttgagaacataaacgtttggaatactttaaaagacttgtactttctacatcatttgaagagattccagaagaatgggcagaaagtaagaggatagagagaaaaggcctggggtgaggggtgggaagcattaataggataggaagaaatgaggaatcaggtgttcaagggagattggtgctacacttttgaggtcattgatgaccagctagtaagtttaataatacgtagtgtggaacataaacagacacttggtgtttagggtagtaaccttacaggagttgtgttttggtgacattttataggggtaggacacatatagaatgaagtagagattgtggttatacagaacagagatgagggactagatgaggggagtggccctagaatgaaaaggaggacatgtatgctgagagaaatgtgataaggttaggctgcataggatgtaccagctgactggatgtggatattaaaggcaatgggggtattaacaattatttttaaaatacagcaagaatttaaaaaacttttaatcaatcaaaaattccttatttaagaattatataaaatatcagtaagtgaaaaacatttaaaattgtattttatcagggattataacttaagtagaagatacatgttaatttcttaaaacatttcatttctgtgctaagctctttcaaagcactggatggtgatctaaaggtcaccaaattctttgtcccaaattggtaattttaaagtaaacataatttcaacgttaggcctattttgttatttgctgagaaatgtctcaatgtcaaccaggcagttctcctctcttattaaagtccatgctcagaatgcctgtgtaacctatccttagtgataaacaaggtggcagatagatacatgataaaacaagtttgccatgtgctcaatgtggctgacatttatacttctcagaccttgctattttagggaaggtatcagtataaccagggcattctttttcctggaactaaaaatccttaataatcagtcactattataaacagaatgatttacatacaggaatcaataaacagttgcttttggttaatggttatctggagtaggaggatagttatatttcaaatagaatagaaagctttattggaatacttacatgtctttttagtttgaggaccttacaagctttttacaaataaatggtttaaaatagtttaaacagaaaatgtcagaacattgatagattatgttttatttaatatacagagaaaaattcccatgaaataaagacagttttcaagaaaaatattctatttataaatatttacaacttattagttatttagattgcccgtgtccataaaaataatacagaaattacactatttatgtctttaaatatagcatgtttctataaactagagaataatgttgacagtattttattttgcctttgttagtattatgtgaaagtcacacttattacatgcctttttctattattagactttttttcctatctagtttttgccttgtgctatacagtatggtgaaaatctatttagctatgtcattaagataatgcttagaaaatgctaatttttaagtaactaagattaagtagtattggatattctttgccttctttattattctgtcattgggctaattttaactagacaaatttattccaaagtattttgagccattatttgaacttcattgctgtaacattcaggaaaaactgcattgtctacctagtggcattcagataaggcatttggtcttaggtacctcttccaaaagacttttaagaggtttgataagcatagcaaaagtgaacgacggaggatacaagaaaatctttgatccaggagtagtctctctgaagcattgcatgacctttccaaaaaataatttgagaagtgcctaacaatagaaaaatatatattttttccttcaataggaaagactttagaaaaaatatactcaagtagaattctgcataatgctttctgggggaccacatttgctgaaaattgcctacgggaaatgactttctcagagtgatatagttttgaggactgagattttaaaagtaaatattttattgggagcaattaatttaggaagaatagtattatgcctattcctctgtagttgattaaagtttactaagtgctgaggtcttttcccttaaaacattactttgccatgttaacaatcaggtcatagaggaatgaattcatcttttgtgttttgctaaataatcagttaacaaacatattctgagcacgtttaaagtcaaaggattgtagtaggtcacaagagggagatcgaaagtataattacatagtgtctttccttctttgacatacaattgggttgaggagaaagacttgaaaacttaatgcaaggcactatacaagttagtaccaaaggaggaaactgaaagagggaaggaaattcaaagaaggaagtttttgtggaactgaatggcaagggaatgctgtggggaagagggggcatctgtcataggcccaaagattaagcactcttttcggaatatggagtgacatagtaagaataaggtggaagtagtgatgaaagctaccatatttgagcagcgtcttttctatgtgaggccttgctagcttatgttgtttttggaaaaaaacagatagacaacctggtagtgatagtagacaatgaatgaattgggccggtgagtcaggaatcatcatcctcttagaggacacagacttagagaaattatcttatttgcctaaatccacatagctggtgatcagccgaactgaacagaagccaggtcttttcatacttcaaaaccagcattccccaaccccatccctccccatcccatgattctgttgggaatgagtgtggcatgtttatgacatagtaattttaaaacttcacccatacaacaactgacataagtcaagaagatagaaattttatttaaaaggctgtcaaatgtattttcatcttttttgctttgatgatgggttacaaatagcgtatcgtttgacaaatgcttatactctgtttcttggatttgtaaaaaaaataaaacaaactaggcctcccatcttcagtagatatggtatggagttgcagtatcatgatgttgtaacagtgcatttcgcagtaggtagacccatttgggattccctcagaggaagcttgtgaagtttgaagataatgtactttctcaccaatagtatgaggctataaaattttcaccaagaaatgataggggcaaaagtttatagatcatggttgtttgattattttatgcttttatgttacatcatctaatttatacatcagtctctgctctctgtaactttacatgtgatgtagcctgtgactttaaaagataagctgttaattgtagagttgtgctgttggagacctgtcactttgctaacaaattcctctcttcatagagctatttagaacatatggcaaataaaattatgtgattatgtgtttttagagaaaaatttatttatataaaatgaaagtctttgcttttggctgcaaaagaaagcatccttaatagcaaatattgattgcagtgccagtgtgccatgtatcatgctataccctttggaggaaaaagaggtaagatgtgcctgttctcaaagtaatttccagtatagtgatagaaatattcacaaataatggacgggcaaaacaaagtgggcacaaagaagccaagaataggctgtttgtgggcagagtgtggaatttgcctaaaaccattcggtagacaggttaactctttagatactttgtatatattggagaagagacaaaatcaactcataatttattaaaatgatgtgatttgatatgtacaccatttagtttttctgttcaagtatttggtaaataagtgtgatgccagcatagtatcatcctggactagacagaagaaattaatttatttctgatgctggcagttttggagaaaggtgggcacatacggttcatctgaatcttcctcatgctaaattcttgattggaagcaggttaaaacactcaggttaacgtttatgttaacagaaaagaaaaatcagtcagagagaggtgcgttgtatttaacattaatgacagagaattttaaatatgcacatgattctctttttcctccagcttttctttctgcacaggaaataaagctgtattttgtaggccagcttccagactttgaaatggtgaaagtgcaactgtgcatattcttctataagaccccattcagctgtgacgtgttgttgtttccaagatttaatctgcattctagtttagaaaattcaggattttattgcttattattattcatttttattcataaatatttgtttaaagcccattacatataaagttttactataagattttaattgaaatttttaagacaaattaagaatatggtttctgattttctgaagtttatggcctatagaaaaaggtccattcataagtgaaataataaaagcaaaacaacaaaagactcgagctttagccattctagtaattattaaaatagctactttcttcgtaggaacttattattttacatgtgtgatcccatagctcttacacaattctgtgtgatttaggcattgctatctttctggctcccaagtgagaagattgaggcttggaaagattaaggttaggggatttgctcaagggtcatatgataaggtactactgtgagagctgagatctcaacccaggagttttgctgtttttctgcttgtttatttccatcagtatggtatgaattaggcacacaaatactcattgcatgtagatttgggacctactccaagttaattctggaaagactcagtgaagaagataagatgtggaagaggttttttttaagcattatggtcatgaaagagcagactatggaatggactttgaagtttcactagctttgaaaggaggggtatatcaaatggcctaatctgcctgtgtggtttgctcagtattagttctactcatacctaataccctctgccccagcactcgccaagatcagcaaaatctacttttagactcaaaatcattaccacctgtgaagtttctgatgtcgcttctgagtgacatagcactctgtcaattgctctgttggatggctttgctgaatggcaccttttaagaagtgccttgagccccaaaagagtttcaaatgctcttgtaatctattcagctgcattattgaagatattagggtaattcaattcattttttcatcactaaaacatagaaatctgttgccaacattaaaatagacaaacatatcattgaaaatttaatagctctacattcacttggagatttccgataaacttttctcactttcccccaaatccttaataattagagcatgtccatgtgtgtatgtgtgcatgtttttgtgtcatatccctatgtgtctatatatatattccataaatgattgtgaagtggtacacaagttgtagctaaaaatgaaatagaataaatgtatgaagctaagggatccattctccaactaatgcgttagttgacaaatttgctctgaaatattgataccattttgtggttccctgtattgaatacaagtatgggcttgtgaaaatatagtatccacagaccctaattagaaacaaaataaaggtattctaatatacctatgcaaatttaaagttttaacttattcatataacagttttcagcttgtcagtgacctgatatcaatggatttgaaaatgattttacctttaagtaccaagaattcttagggacatgtgtgtgtgtgtgtattcagattaaagattccatgctaatatactaattttttggcaagaaaattaagcacctgtatttcagtttaatagtactgtggtaaatgaaatatattaaacatgcagattctgttacattcacctaatattaatttgaatttttaatattctaggcactgtgctagatattgaatacataatggtaaacataaacagatagtaaacagttataaaatttagacatctctcaattttcaaattggccattgcagaaatagtgacattttattaggttttgttgccacaagattttcaataattaaaaaaaaattatttatagatgccagtaaatatttattttacagcatctagatgccagtaaatatttattttacagcatctaccaatgttagatttactatgcacgaaggaaggattttattttcatgtaaagaaaaatgccattttatgcttagaatcaatgctttacaattaaacaagagaaatagcatcacaaaataatacgggaagagaaaactcattttgagtagcagcaaaatattgtgagtttaaaaggtcaggccagtacaggaggctccagttttgccactcactatgcagaatgctgtgacagccagggctgatacagctgaaaatatctgcagctttggaagccttgtaagtttcagaaggtcattttggcatcatgataggagcacagattcacatggaaggtcaaactggacagccaggcaggaagataggttgctgaacccagtgcttgtagattttagagcaatcaccaactgcagtaactgagttttttaattcaatgcagccatctttcattgtaatgtttattggggaatgagctttacttggtggggaaattataaattaccttctctcttctgaaacctaagtgttgcatctacaactttccctggtatcaagacaaatgttactttaattttatttacgtgtgatatataccccatcaagcttacaaaagtaaagtgcacatcagataggactgttgttgttgttggtggtggtgtttttaatcaattagaaggcaaagaaatgaaacaagtacttatgatgaaattgagcactaaatttatctctcagcttcctggcaactgaagcagaagctttaggaagtgaaaaagtcctgagtttatttaataagatttcttcagatcccatacactgtcttattcttagccctttgggtgtttagttaaatatactgactctgcccttgggtgaagtcttgaatgggtgaattccaattactaaaaaagtgaaggctgaattctttagcctgcctttaaggcccttactgatttggcttcagcccaaagttccagggtcatcttctgccagccccattacatacaggtgttccatacagaccagttcttccagtgttgatatgcagtgctttcccacatccctgccattactgtctggatttctacagtttggatttctactcctttttgtctctaaccaaatgaaacttgtccttccagaccaaccttccatttcttatcccttttgaaactaaccttgacctctctctttaacttaccaagctttcttgttacctctactgtgtacttctcgcttccttttttatatatagttatttgtgtgttagttttatacctttaattaaacatcaaattcttaaaggctggatccaagtattctcgctatatctaggctacatataaaaggtggtcaatacacagttaatataatcaatacacatattttatgtgtattatatattgttaatgaatatattcatttaataaagttactgttgaatgtatttgaatttcttgaaggaaaacatttcttttcctaggatagtagggaacaaagaaagaaaacctaaaaaaagaagcacaattagagaaacacactcctgtaatttttctcaaaggaaatattttgagacagcagaaccaagattataattttttttaattgttttgactttgggttttctttttataagtcagcttaatatttgtgatttctctgtgccaaaaagtaaccaatattaatagagaacagctttagtacatgtaaaagaaaaaaatcctttatgtcatttcaaaccctcagtgctttctttctgacagatttttaatggttttatcagctgttaattaggttggtgcaaaagtaattgcagttttaaaaaaagatcgcaaaaactgaaattacttttgcaccaccctgataaaaaattggcctgactatattgctttgaaatgtttcagacagtattctgtctccttcattgctcttcagatactgttttagcagtttatctagatcagtcttactgtgtgcatagtcagcatacatcagttttatacttttaaagcggcattgcattttacctacgtggaagttttctgcagacatattttaagcttctctaagaaaagctctgaagaaaatgtaggctcctgttgctcggagggctgatgaataaatttaaaaaaatcatgctcaaagaccacttccttgacaattaatctttcaaaatcagctacggagtatctagaacttcataatctattcaaaattgattaacaatcttaattgagaagacatttgtatctgaagtgtagaattttcttgtctccaggtatacattattaatgtttagtgtctaccccatggacataaaagagcaatagcatccgttctcagctctgtaaaagagaccatcttatcttctctagaatcaatattcaggggtttctccttcacttacacacacctcactctgagctaaccacaagcaatgcagtagtggtacctccaataaatcccactcaccccctatctctctcccttcttttggcttctgttgtatatattagtagtcattgtcatttctaccaagtttggtattaaattgctagcatgtatcgtgtatcgtgaatgaagttttacatttgaaatcagaagagctgatttggagttctggttcttccatttatttagcatagggattttaatgggtcagtcacttaaccatgcaagcctcgcctcaatttatttgttcacaaatgagcaaaataatataaccaaccatctcttagagttgtgaggaacaaatagtaattaggatgaaaataaattgtatgtcaacatataaaatattatttgctatttttgaataatagaatgtataagttgttgggaaagtaaatttctatgcttggcttcttcagtggaaactttttttttttcaattttttttttttttttttgagacagggtctccctctgttgcccaggctggagtgcagtggcatgatctcatcttactgtggcctcccgggctcaaacaatcctcctgcctcagccttccaagtagcttgtactgcaggcatgcaccaccatgcctggctaatttttgtattttctgtagagacggaggtctcactgtgttgttcaggctggtctcgaactcttgggctcaagcagtactcccgccttggtctctcaaagtgctgcgattataggtatgagccactgtgtccatcctgaaacttttttttttttaattaaagaaccaaatgaacaccttgcagattttatgtataagccagaaagaaagctcagtacatgtatagaatgtagcacaagccaacttttcaaaaattaatctttttaaggggcattatgtaatgaaggagcatacatttttagttttatccaggataaaagtggttctttttcccccattaactttaacacagaggttttactttaatttaaattccaaggactaggtttttgttgtatatgaagaaaacgatttgactaaatccaatgtaaatgtttttccttattctttgggggcacacacatacacacattaatccttattttatattttatttataatataaatatttaattatattttatttataatacaaatatttaattatattttatttataatataaatatttatattttatttataatataaatatttaattatattttatttataatataaatatttgtattttatttataatataaatatttatattttatttataatataaatatttatattttatttataatataaatatattttatttataatataaatatttatattttatttataatataaatatattttatttataatataaatatttatattttatttataatataaatatttaattatattttataggttgaataggttccttgtttatcttttttgcaaaataattttattgttataaattgttcttattataagcaataaataaggaacctaaatatcacaatctgtaaagcattttatttgtgtgtgattttatatgatagttcattagacattagataggaaagtatggaaagttttgagattgctacatgattgctcttttaatttgtccaatgtattcctttaaatgttgtgagggatttttttaccagtgaagtagcttttgcatgctaagttgtagtgaactgctgggcagaactaaaacataaatggtttgaggcatgattaatagttgtatatggtggccgggcgtggtggctcatgcctgtaatcccagcactttgggaggccgaggcgggtggctcacgaggtcaggagattgagaccatcctggctaacatggtgaaaccccgtctctactgaaaatacaaaaagtagccgggtgtggtggtgggtgcctgtagtcccagctactcaggaggctgaggcaggagaatggcatgaacccaggtggagcttgcagtgagccgagatcacaccactgcactccagcgtgggtgacagtgtgagactccgtctcaaaaaaaaaaaaaaatggttgtatatggtgtagtatcttagagtgatgtgcagtggcatgcatgatttaaaataatattaataatcataacagagcttttttgtaacattttataagcatactaccttgctgaagtagtcgatggaatataatcaaagattgtgtcaccaaatctttaaacaggacattttatcagagaagatactctggtttcttaggtaaagttatagggtagaaacacagtaagcagtctctggtaagaataatattttagccttgattgattatggttgccaaaatttaatggaattaaaaataacctgggaaaacatagattcctggtttctatcctcagtaggtctagggtaggtcccaggaacggtatatatttttaatagttacccacgagtcactgattcagataatccaataatctttctggagcatcagtatcccagagaaacaaatgttgccgttaataaacaatttgcagttatttcagtttattagctagctacgattgcattctgatttgctgtggaaagctggtcattactttttaagagcatatgatgctgatggaaacatgtagagctttaatcgctgtctcattaaaaggatgtagtttattctttgtgtttccttatttgttacagcttttccagaatgcacagaaccttatgtgcaattaaaataattaagaaaaagatattgttttctatttagcaaaggaactaaatctcatgctcccttatagtttctgttcaatatgcattctcttttgaaagtacaaatttgtaataatacaatttttgatctcgtctcccaagaagcctaactttatttatactctgactacacggtaaaatcacattgtcaaaataaaagcgttggtaatgctcacattctgccaaccaaccatatttgaagtcttttaaaaattcactttcaggtactttattctgtagactgttatttaataactaagaaagagagtttgaggaggacaaagtgagggcggaatgtttttattttccaagaggacatacatgcaaaggcataatcatataagagtatatacctatcttggttattttaattagaagtgcatgctgcttcagggagactccccactcctgactcaggaatgactgcgagtggaacccccgcctcagggaaaattactacatgggaaaatatgcttgggcctacatgagttttccagagttctcttgtaccttagctagtttgataatgctttgcattatgtatagcagttgtcagaaaccatttcctttaatcagttagcatccaaaaaaggaaggggtagcagatattttctgacatttgtagatataatgtattaaaaaaagcattaccttactcttatgacatagtgttgtcagagatttcccaaatacaacatgccctgcagattcttaaaactacacattttccttttgttaataagaaaataacagtaaagtatttattgtctattttgataccctgtcaacccaaacatgtattccaaattccagcctctgtttctttgtaaataattacaaaatgcaaatactatgattgttttaggaatgaaatgccatgttttgatgcaacaggagttgaaaaactgattttacaaatgtttccattgattagctgctatatgagggctaacagttgaaaatattttggaaaaatacaaaaacaggctttcatttctatttatagaaaaacagacatactttttttgcatgttcccacaagagaaatttacagtgtagataaagtacagcataggcttaacaaatatagaaaaatatgttattgactcttggtggaagtacatattcgtaaaggttttcttaaagttttttattctagttcaaagttaatacatatatgaatacacttcatgttctaaggatttatattattaaaatcactcataagcatagctttttatatgcaatttcagcattgattaaaagagtgaaaaatgggcattaacttagttgactactgataacaaaatggacatatagtggagtaatatataattgttaaaaagtaattatattgatctgtttctattgacatagaaagatcattaatatattttatattgtggaatattaacataatttgttgtttaatctctggacctagttagatatgtgaattatgtgaaaccttcttccaaggatatttaagttacattgaagtgaaaataggagttgtcaatgcatgtctttgttttgtggcgtatcttagtcttttaaaccagggaaaaacaactgggtcttgagtcagtgttagtcagtgaaaacattattcttgtttgtgagcatatgtgaatttgttatttttttgaaaaaaagtcaagttaaactgatatatcttgttatgaagaatatatattattatgaggaatatattcagttaacattggtatattttttaaaagtatgtttgagattatttgttaaaaagtaatccttaaggtcagttgtataagtcaatagaaatatccataggattgtaatgttaaagtgtgtagcacctatgtggcttgagtatttgtaagtttggaataagaaatatgttagtgaaataatagggacttttactgattatatggaatggaggaaatatttgtgtattacgttgtgtcatgagaagttcactaatttgtttttttaggatacattcgagcaattccatactcattcgtcattggttttagtcattgtattctgaaaaataattattttggtctttttatttaattataggcatagatttttctatactttttttcataatgattaatagttaaatcacatattttgggccatattcaatataaataagctaatacaattttcctgattgaggttatcacaccaggtttaaaatcagacatttggaaattcaaattctatttgttaagataaagcttctgtggtcagatttagtgggtagtactgagggcaattatcacattaaatttttagaaattctgaacagtgtggcaactattaagtttgatcctaatgagatatgctttatattttgggcaggtttttttttaaattatatctgtcatttttttcacatgttgattttgtaatttatcctacttgagtctgctaaaataggaaaaaaataggttaattatggagaagatcttataactattggttgtgagaatgatttctgtgtgagagggaaagttggaatagaggggcaaagaggtacaaaatgcagcagatttcaccaatgtatgaggtgctgtggaaatattttcttagttctgtgatcaattaacttcatacttatttttgtgttgtgcaataatgtcattagggatgcacagatgaatttgctaccattatttaagcagtgaacatcatattttaaatgttttaggcagaggtgccaccaacctcagcaagaagcttggtgatgttcagaagatatagaggttaaatatgaaaactatgattttggcccttagttactgtatcaaataaaataatactcatttaagtaagctttaggatcaaagtctataatcaggacattgtaacgggaataacagtattactgtgtgttgcatttcatttagcgttcacatttttgttgtgttagttctacattgacagattcgggttgggtcactgtaccattcttcctgaaaattgccaagatgatgagatttgatttttctaccatttagctcttgagcacataacagcattttaacttttgctgtagtctgtgttctgattccctatttactattttgaaatattaaatgatatggacagatcagatatgtctacctgaggctaacaagatgatgtctttgtgtaatatataggtaaataaaacactaattaggagtagtgctttctcttgtagaacaattaagtagcattcacagttttatctcattataccttcttgtagaaggaaatgttaaaatacttcctctttgaatagcatcagaaaaaatgcagtgtttcttttgctggaattgaagactggttctgtcagaatttcacagataattatttaaatattttaaatttgcatagccacataaatctgtttcgaatattccatggctcaaaatatctttcttcaacttcataatcaaggaggtatttaaatatgttgctattttaacttcatcgcctcatgttctctttccaatgagtgacgtttgatgctggtttcattcacttataaaggtgacatccccaatatactaaaccatatagcttaagcattgtaatttgtcgaaaatacaaactagtctgatatactaagaaaaatcttcagttataccacaaatattaattgttcgtttcctctgggccaggcattgttttggtgatctgtttctattaatggagaactagtgtaaccactgccttctctcatggagcttacatttttgtggcaaaggcaaatgataagcagatagcgagataagcgtgtaatattactctgctttcttcacagtactatgtagtattagatggggtttttttgtttgttttgttttttagacgaggtctcactctgttacctaggctagagtgtagtggcttagtcatagcttactgcagtcttgaactcctgggctcaagcagtactcccatttcagcctcccaagttgctgggaccacaagcacatgccatgccatcatgtgtggctaatttttaaaaatttgttttctgtagagatggggtctcactgtgttgctcaggctggaagtgtaatgttatgtacttctctcaaaacgagtctggactgctgttgggaggaacagaaggttgggtgctttggatggtggcctgaaaatcttctaagaagataactttgcagtagggacttggacgaaggcctattggggtatagagctagtatgcaaagtgcagtgattcattgtgataattatcttctagtgagcttaaaccttttacatttttaaaaattttgcctgatacaggaattaattcaaaattcacttttaaatcattgtctgtatagaagctttatgttctgttttgtcctaaatatgaatacttaaggatcaacaatcattttctaattggaatacagtttagttgccactggaattctaatctttggcagtagtgtgtcacctaaccgacactccttcattatccttcctacagtagaccactaggtgatttagggaaccaaactgttgaatggatcagaattctaaaagactgcttcgacagagcttagattacttatttgcgttagtaaacacaatcttcctttcttggcagcagctagtctgaaatgtggcagaccagcaggccacattggcagtctctatgccattccagaggatgtgtgattgaaagttatctttttctttgcagtattgttaaaacttagtcatttacatatctccttcatgattttcatttatgtgtagtctcttaggtatatttgtgtgtatatgtatctattctttaaatcttttttaaaaatttatttaattaatacttttttttttttcagacagggtcttactctgttgcccaggttggagtgcagtggtgtgatcatggcttactgcagccttgacatcctgtgctcaagcaatcctcctgcctcagcctcctgagtaattgggactacaggcatttgtcaccctgcctggctaatttttgtattttttgtagatatagggtcctactatgttgttcaggctggtctcgaacacctggcctcaagcagtcctccacttcagcctcccaaagtgttggattacaggcgtgagccacggtgcccggccctttaaatttgtaaattaaactttaatttcttcctaagttataatattgatgtaatcacagaccggacacactagttttagcattctaatccatctgttaaaattatgttgtttgtgcatcacctgaaattgccatgggtactgctggtagtgtgcttacccctcactgagaaatacttacctctgctttttgctatgtggagttgaatagtgctgaaggctgcattaactcgttcagatggcagttcttcccatataatgtataacatctttgttactctacttagcaccttagtgaatacagagatggctgtacagcctccagaaatgctaagttggttggttgtatatggaaatctctgttaatatttgggacaaaccctgggaataattgtgtgagcaaacttagtttactaaagaactgcattgctaattatggacttgttgacaccagtgagccaggggaagaagttgtggttttgggcaaggggttctttcttatcaactccaaacttacagggtgaagttagccatctctttcagttagattgaaactatcttaataaacaaaaatcataataaacgacctcaaaaaattacttagttaacttcctcagtatataacttatatcaacattaaaagcatattaaataaaattcttcaaaattaccagctaactactctgggatataactggactgattgcctatatttgctttagaagaacttttgcaatgattagtaaacatatgtgagcaagaaatttaaccttgctcatagaggccatccagttctccaaaagagaatttcattttcataccttgtaagcatctctttatcttctatagcagtaggtatgtgactcttaaataggcattcatatgaagccatatatatatatatgtaatttttaagaataattgttgaaagaataagaataatttcattcttctttatccttttctcggtttttattatctctgtcatttcaaattttatttctttcctttttattttctcccttatatttatcttaaagtagaatatatacatgatttctgatatcattcaaaaagaaattggttcttgtggcagaatattagtgttgtagatgatgtcagataaagcaagaaactatagcgtttggaatgtgatcagtaggttaaagagggactgctgttacctattattcagattttaaagtttgattctttttttttttttttttttttttgaggcagagtctcgctcggtcacccaggctggagtgcagtggtgtgatctcggctcactgcaagctctgcctcccaggttcacgccattctcctgcctcaccctcccgagtagctggggctacaggtgcccgccactatgcccagctaattttttgtattttttagtagagatggggtttcaccgtgttagccaggatgatcttgatctcctgacctcgtgatctgcctgcctcggcctcccaaagtgctgggattacaggcgtgagccaccgtgcccggccttaagtttgattcttacaatatttttgttgttcagagaagtttattataatgtattgaaatataggtcagatatttacctcagaagcaatgtacccattagtagaaatctttcctttaataattatttacagacaaaatttattttaggccaaatatgtttgcaagaattctcataatctggacattacccacatatctttaaacattatatctatctgtagaacaaaaccccattacttagttaatgttttgtgaattcagtattgatccaaattctataaaatcttaatttaccaaaagagatttctattttttgaaattctttttttaatatagagaaggaatataaaacaataatctgatatcagcagtttagtgaaattgatctataggatataatttgagtttgttacccacagtgccctatatcaagggcaggcacatacattatcaggtctagctagactaatgcataatggccagtatctattttaattgttcagtgtctatgcctgaactaattattaatactttgattatcatccttgtctatgtcctttacaattaaatggtacaaatctatgttgataatgctttcagtagcacttttgaagtaaatagaatttctctgctacagaaagtaaatataatcagaacactgatttgcaagcattttagtaatcaaagtatattttgtacttgagggattgtctgtaacctggcaaaaaggaaaaataatcaactctagaaattaatttttagttgtatttagatatgactaccaagcaatgcagatatttcttggggtaccagtcttcttacatatattgtctggatgccatagatcatgatattaaataatctatttcatcagtgttgggaccacatcctcccatacatgtttatttctgtaagtgtgaatgaagtttactcatttatcaaacattttaaaaaaagatctgttatgttccaagaactgtgtgatggaagacactggacctacaccctgttgtcagggcatatataacattgagggggagaggtacgaagagctacaaagtaccagaaacattctgagatggagtaatgtttagcatagttgacccagtcctatagagaaggtgatttttgaacagcaatttaaacaaggagaaggaatttgccaagttgcaggggtgaggaagtgtgtgtcaaaccaaacagggagttagcatgtaacaagtcccaggagctcacacatgtcttggcacctgccaagaaccctcagcaactcctctccaggggagatacaagaggtacagcactgagagaagcaacaagataaaatgtatcagtttgttaaaagggaaaggttcaagaaagagggagttgtaaatcatgttacaggtcaagtaaaggcaagaacaaaacatagtctttggacttggctttcctgacagcattgatgaactttgctgagcagtaaagtaatgggtgtgaaagtcagactgataaggattcagaagtgaatgggaaaggaagaagcagaaaaacagcacggtagatgactctttagatatttgcttgggaaggatggattaagtgcattagggagaggaggatgctagccagggcagggtcctcttcctcctgccatgtcaccgtctgcatgttggagtttcttcagcacatttggaagctaagagaaggaactgctgaaagacagggcgtgcatgtatagaggaggcagaaaaagaactagatcttgagaatgactgagtcaaggtggaggcttgtggaagcttaactgtgggcaggaggagggagaactgggagaccaagaaagatacagaaagataggttaaagacttgtgagtaggaaggtaagaaaaagttcatgcttaagggctactgttatggctatgaaatattcgtgacgcataatattattatccactattgctaatgaacatggagaaagagtaatgaagttttagaaaggctgccgtgtgcaatgagatagggagctgtccaaggacagggctagattgtgaggcagtgaaagggcctatgtgaccctggaacataataatttatagaggcaatgattgtgtgtgtgtgtgtgtgtgtgtgtgtgttttcaaatgtatgtttcagtgtgttcatgtgttgtattcatatatgtgttcatgtgtgtgtgtttgtatattttgtaccctagaagtaatccaaatcctgatgcagcagttgataatttagtttaccaatatttttggaactccatctattttgcatcattatgctaagccatggggttactgagatgaataatatattttttctgtccttaaaaacatatggtctagtgggtcagatatataaggaaataaaacactgtatagggcataggtgcagagataattcagagaaggcagtattacgatatggatggatagagatggggataatgacatcttggtagctttttggaggaagtaacatcttagctggctttagaggaagaaaatagttacatgtgaggcacttgaagattctgaagagaaggagtaaagacattgttgaccatgcaggtggtccattctcaaggcatgaaatcattgagtaattcttaatgcagaacaaagtttcaggaagatagacacagcttacagtttatgactggacctttggtttttttttttttttttttttatagaaactggcattaagacctaggaacttttttgaaaaccaaaatatttcttgaacactggggatgaggtttttttttttttttttttgatggagtctcacactgtcttccggcctggagtgcagtggcgcaatctcggctcactgcaacattcacctcccaggttctaagtgattccaggagaatcacccagcctcccaaggagctgggattacaggtgcctgccaccatgcccggctaattttttgtatttcagtatttttagagacagggttttgccatgttgaccaggttggtctcgaacacctgacctcgtgatctgcctgcctcggcctcccaaagtgctgggattacaggtatgagccactgtgcccagccatgggttttttaaattttttttagacagagtcttgctctgtcacccaagctggagtgcagtggtgcaatctcagctcactgcagcttccgcctcccgggttcaagtgattcttctgcctcagcctcctgagtagctgggattataggtgccaccaccacgcccagctaatttttgtatttttaatagatatggggttttaccatgttggccaggctggtcttgaactcctgaccttgtgatccacccacctcagcctcccaaagtgcggggattacaggcgtgatccaccaagcttgattgattttttaaatctctatcaaaagttgtagtcgtactgtagtattttccaaatagttttggaaagtagttttttaaacgaaatttagtgttaaaatggcaatattaatcttaaacaatttaagttctagatgttcgtgttttttaatgtacgtatgtatttatatcctatactctagtttccaaaaattataaatataccatatgccaatagagcaattttggctcatgaagaagtatcatcaaatactagttatcatactgtgtcattgcctctttaaaatgtgaaaattttactttttaaagccttgttttcctcattggcaacattcaaacaaaaaataaagaagaaaaatcctgatagaaaaagtaagttgttaaaagtaaaaatgccctgctctaagaagtagtcttgtggtgctgagttaactgatcatcaggcaacaggggatccctcatcccccaccctccagctttgtttggaattgtacttctgaagtgcatcacgctgctcaaatcaaattgctcacttaatatttaatgtttctgcgatggaatcactttctcccttgaggttgacttcagatttaccagacacactgacaacactgtactccttattttccccacatgacctcagcttctgctttaaaaatgtacgaataaaggatgcttttgttcatatcttgcctgcctgtgatatattgacaaagtgtctgcgggctcaatggaatagttttacagtatgagtgctgttttcagtggaggggcaggacttgggctttagaaggaagtgaattggataggtcaggagaatgtaccatttgtaaacacccctttccttttttattcacgtgtcaggacagcaggagcaggctgttcagtgcccgtccctgcgcagagccggagggaaagcagcttggaagtcagctgcaatttttaaaccttgctttttattccctggtaatgatcttcaagtgcttagacttgtctgagaagctgttttgaaactaacatggtttagtccactaactgcatgttgggtaaattcaaaacccacatgctcgtcctcttgcagtggaataagtcacatctgatggacattttctgtgcttatagcatagtaatgaacgtctgacaggcgcgacctttcataagacaacccacactattggctttctgcccagaatattgctgcaacactatctgtgattggttatctctctatcatgcattgcttcacaaggggaaacggcccctttttttaataaatctacgatggctggctgcaatatgcctcactgtaagtattttgtgtatgtatgtgtgggagagagagagagaggctgacttgaatattacttagtctggtatcacatggcaaggttgtgatactgtaggacatcagtgaagtgctacttagtaaatcttaacctatctcttttttctacaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaagtgagtaactattatattcttttaaggatattcaatgattgaatgaggggtatatggacatacagttctctgcatatgggattatggattgctttgttcatagtttagttatacagtgtgttgatgatgttgggctggggaactttacgagaagcagtagaatcaagtctggccaaactttgttatgaataactttatcagtcctttcactgcatgtttttttttgctagggcagaaagtgttgacatatttttcacttagtaatggcaaagtgtctgtctgtccctggaaatggtaaatgtagctacctgtgagtgtttagcatatgcatatattatatataaggccatggcaatagctgaatgaggatgatttttatttgttggtaaaggcattgtacagttgcaaaagagaagcagatttaaaatcagctaaacttggatagactttttactcttttaatattttgacattttagattttctttttattttgtgggcattttattttcaggccagagccacgcattttatggaaaatgtaactagaagtaaggtgctgaactgctgctacagcaccttacctgaggcacaaactttgttgcatgtgagttatataaataagtagaaactcataagtactattgtttattggatttttccagcttcaaaaattctaatgtgaattagcagtttattttctgttagatcatgatttttttttatttgtaatagtcttagctagaaatgttaaaagttagcttttgtgggcaccataatactaaaatatttactttagtgtttcttgacattcaaaaatgtcattggatttgtaattcaggtatcatatttgaaaatgagtcttttaaaagataacataaatatctttattttgacacacaaggtcaagactagaaatgtgttcctgggtactttcagcctacttggtttaatcaaattgcttttgaatatgaatgtcctaatttaattctttggacctttgaggggaggacactatcacttctacatatgtagagaagtaaaagtctcatagatccatcttgtctttaaaaatatatggtgctataataatcttttctttaataacatcagggtgagttatgagttaattgtttcagttcattgtttcctggtccattttaggctgttcattttgctaaagtttttgccaaagatttcgagaatatgatctttagagttgaacagaaaggaggtattaacaacaaaaatattttaaaatgttagattcttcttaatgtcatagtcctaaagatcaataagcaaaagttataaactcccattgagactttcttcaccctttcctttgagaggcatcagtgaagggcacagtggttgtacctccgtgaatgtgtattcctaaattcatgctggctgaattcaggtgtaattagagactgagacccataaaatgaggggcaaggagctaattactcttgtcggtaaccagctgtggccataagtaaccctgttttgacccaattaatagtaaatccaatttttaatcctacagacagttgatggtgcactcgtagctgcaaaatgaaggacattaaatttggctgtgacattgagtggttacacagaagacctgcttctacaacatttggaaacattgtgaaacattactattcagttgctatttttccatctcaaaatatttttttttagttgctgctcacttatggccacagaacagtccctttttgagtaaagcagcaaggttgcttaatgacatgctatgtggttaacaagattcaactgccacatcaaggactttaaataatttcaagattttaaatgtatttatgaaatgaactcattacagcagctaatcaatgcaaactttgtcctttttctttgtctttctaagagaaactgaatttaatttaaatttaaattacagtgtctaaaacttggtaaaatattttaaatttgaataagaggaaaaaaaaaacatgaatttatttatgatggagcttcatacccaggacagtagcttcttaaatgttagtaaaataattatgttaagcattaaaacaattttgaatatgtaattaagcatttatgttaaaaaacatgtttcttacgtgtgtgtgtatatatttataactgacacatgtgattctttgtacagtatttagaatccttcccttcagatagcagtcctcttgtattcagtcttgtggctaaaatagatcaaaaacatattttaaaactgttaaagtaactgtatgactcatgcttgaagttctgaaatttgggagcgttatgaggtttccatgccattaaccgctagatcatttgcattctctcacagagtaaacggaaaaaaatttagaaaacttgtaataatcctgacttctttaataaaatgtgtcctgtgtattgcttaaatccatagtccagccttttctgagttcttgagccatgagatggaggtggcctgtgtaatctactatttttagaaagttaggaaagcaaaccaaatactctctgagaggaccctatgaaatggctgtacccttcagctgtgctgcttcagactttggccaggctcccaggtgacttacgttaatagcagacttctagttagaagaggagaatttatttcattaaaaaaaaaaaaaataagtcaaacagttcaagaaagtattcatttatgtaaaagaagtcaattggtatgttactaaagataataggaagaaaattagctcactattttagttgcatactgatgattttaaggtttaaataattagatttaaatataccgtatgtaaatgtagaagtctgtatcgtaataaatctgttgctaagtaaaatgggaatacatgacaacgaggaatgtaggtattaagaatgtcagaattagaacgagaacagtaaaagagcaaaagctgtaataatgtgtgctagtatataaacaatactctaaatacttagtttctctaattttccttttacaattgcagttttaatttataatagtctaagagcgtattcaagctgagacttaaattgcttacgtgctatagatttaggtgtattagctatttcagaaatccagaacatttgcaaaggtgcattattttatgccaaagaggattatgttcccctatggcttgtgaaagagataggaaaaaagaaaagaaaaatattaacactgcaagccaccattagaaaattatatttcaaaaatgatgtttcaaatcaatgacaaattgcctattcagtcatgagctctcaactaaaatttggggagtcaatgtaaagaaagcctacagaatgtattttaatatttgccaagttatttataccctcaaaaaaaaagcttttacgatatgatcaacagaaatagacttattgtttactgaattctatttcaaatacccattcatttttcaggtactagggatgggagaaagagaatataacctttatatttactatctattttccaaaaatctagcaaaattcttttacctttgaaaactttagtcacttgttcctttatcaaattgagccattttatttaagataattaaaatttctttttgctatatacagtgatatctatctataaatagcaccccgatcagatttatcatagacacatttgagatcagattccactgcaaagtggcatacaatcaagggtgctgagaacagttttaaagagcctctgcaggcttagcagaatatatgaagtatggaaattaggtattagaaggcacacaaatatatgtacatacaggtaaatgaacaactaaagcactcaaaatcagtaaggcaaacaagtatccagatggtcacatatggattggatggcataactagacatgataaagtagtcccaaaggtggttatagttaaattttagaagatcctctgttgctagcatggtttatcctcaatccagaaattgcctgtgttgctgctgttctaagccccaagcatagacttttcatcatattttaaaaaccagtttcactgataatcctgataaaatatctgcaagttttagactaaatatgcaattttcaattaaaattttgatctattagggtcctaactggaatcactgttaccaggaagtttttttgtggtttgatttttaaccactggtatctcccatgtattaaaactttgacagattattatatatactgtgctggcacatatattcaatgtgtctttcagtgacagattgacatatcacttccttgttttctcctaataacttaggagatgaactaactataaggcataacctgcgcagcagtatgtttcatataaaaggtccctaaggagaaacttcacaactttgtaaagaatatcctgtgaatatgctgcagtgtcatcaactctgacataaacctttctttaatgaaattctcaatagctgcagttgctttggtgaaactagtaattgtattcatttgcctgtttatattagaacttttttagaaaacttttttttatgagtaaaggtttttttagactattagataaattgtaaaccatgtttcgaatcaagctacctgctgcagtaattctagaactatttattttgcttcatattataagattttggtacactgcgtctactttttttctcatgaaatcttgcttcactgtgtgagtgtgacaaactaaaaacaatttagacctcaagcaatgtggcacttacagctgaattcagtttcattgtaattcagatgtctgaagctaatcaaaattccacggagtacccttgaaacaattgcatatataaggctgtttctcacttaaaagagacaatgcagtgtggggtgaattgtcttttgaagaactgtatgacacatgcccagttcaggtgaaaggtgagaaatggaatgtttctcagacctagcacagacacctagggacctagtttgggaagcttatcttgtcattttccttgccaaggataagtagaggatttcagctatcaacattgctaatccgttacctttcatgctgagcaatgtctctgccttcccacagacttagacaaagcttcttattttcttacaaagaggtcctattgaggaaatttgaattttttttttttttttaaacttagcagtactacatcctgtgcttttagataggtgagcaattttccatgttaacagctaggccaaaaatcatgactgccagtagaagtgggtaactagatagatagatagatggcctttgatttagcactgatgatagttattagcatgtagcaacttaagtaaaagcaactggaaaggcttgatagaaattctgagttgtttgaagtataatagattattaggatagtaatttctttgtgaattttactgtaaacaagcttgattctagtgaggacttatgctaattgctcacttatactaacagcaactacagagtttttatttaatactgtttcttatacaaatatcatcaaatgcacatctacctacagcatcatccctacatttttggcacatgtttgaaatattttcactttgagataaagtttgatttttttgctagcgataaaactttctatgctatgagcttgtgttttgaaaattactgataattactaaacagtataacccctgatatcttctaatttggttgacaggctgtttgtcctctggattcctgagggccttggccatctctgaccattacatttcttcttttgttatctctgagttctttccagctttctaattgtccatctttagaactattggttccgatcttaaatatgtctttccatagtcacacagaagtgatttagacattttgtctgtgaagaattagattcagctttgcataacagagacacctcccctaccctccccagcatttggtataaacaaattaggggtttatatttcagtcgtctaggtctatttggcgactctatagtcattggaactcaggttccttctctcttagttcctaaggagcacatggcttccaactttaggattatttcaaaattgcaatgtggccactgcagtgccagccatcatatccttagtctagcaggacgcagaaaaggcaagacaccataactcagcccagccaggctccttttaagcaaaggttctctgagcttcagccagtaatttttcagtctcttattgactgattttggtagcagggattgctaggaagtatttttttgtatgtttgtttgttttgttttgtttttatttattattattttaaaaaactgttgccttgattgaaatcaggagtctggtaggtaagacagaaggggagaatggaaatggatgttcaggagggccatttctggaataaaagagtgtttatttttcctctcataaaactttcagaattaagtaaatctctctggaaagcatctgggtaagggaggtggttgaagagataccacttttgaagagaaactgaagtcttctcatcttgacaaacttgtcatcacttctgtcttgcttatttagtaaataaaacctggcatatcacaaatggatttatttttccttatagagaaaactaaaacagcttcattttttatcttcttataactgtacttatttatttatttatttgagacagagtcttactctgttgtccaggcttgagtgcagtggtgtgatctcggctcattgtaaccttcgcctcccacgttcaagcaattctcctgcctcaacctcccgagtagctggtcctacaggcgtgtatcaccatgcccagctaatttttgcatttttagtagagacagggtttcaccgtgttggccaggctggcttgaactcttgacctcaggtgatcagcccgccttggccttccaaagtgctgggattacaggcgtgagtcaccgcgcccagcctactattcatatttatataaacagtcacatttttataactggaatatagcagaaatgccatgtcattaaaaacaggtcccaagtgattttatatgacaaaagaatctgcactttgatttgtatttctgctgcttccacaaatacactttcttattttttccgtatggagtaaaataacaaggtgagttaatatttattgaaacttaatgtatgtcaatcagtgttttcagtgcttttcatttttttcatagtattttgtccctataaaatctcatcgagatagttactggtgttacttccatttcacagatggacacactgaaatacagagaagttaggtaatacatgcaaggtcagtcagccagtaaaatgtggacttggagcctcgtaatctgatttcacagcctgtactcttaattgttttgttatgtttgctggaaaacattgcttcttaatttccatatgcatattctaaggattcgacaaagaaaatataactaacagcagtacttaagaataaaaatgaatatccaagacaaatttatagtacagggcctaaaacagtaagtactcagaagtaatcactgtattttaagtcaacaaatgagtcaaggagtgaacccaaaatagcagaaagaatgctgccaccaactttcaaagatgttgtatctgttgtaaaatatatggccatataggaaaaattttaaatgaatcatcttagataactagtcactgtataaactatatagctgcctccccagtgcataaaaagccatattcaaaaggtttaattgtttagaaaatgtttttccacagaagcaaggtgattaagtcatcgggtcaaccctgagaagccaaagtagcccagaggatgcttgagttatagttcagtacaaacagtaccttggaaaccctggttattaattaaacccaagaggctccatagaagtgttatcttatcataaatcttgagaactcctagagtcacagaccccagctgcttttgtcaaactatttctgtggcaaagatgtattttaaatttcagtttagggttccagaaattcagcttgcctagtgcaggggaggtggcctttcccaaagtcctggaactcatgctgtgagccagtgtagttttccccagctttaactttgggctgcttctgtttcctgaagctagtctttaatagggcatttgcttagaatcagcaggatctaaagacagggtatgcagtgaggagctggagtccaaagcttcccacctgtgtaacctttagggtgggaaggtgtcgtcaatatgtcttccaagtgacccccatgtttctaaggactcagcctgcctgttttttgaatgtagtgctcattgatcctgggccctgtctactgcagagcttaatgaacagcttctccccattcttccccctctctgaaattttcagctgtgtggttgttgctgttgttttctaaatactagtagccatggggaaacaggtagatcataaaagtatcaaactcaatttttgttttgttttgtttttttttttggcattttatcataggatatggtcaagagaccggttgtaaaaactcagatgtgaggaagaaaaccattaggaggtgataaggattcaacaatttaagtaatataacttatgtacttcctatgtcaaactttagggaggcagatgttaacaatacagtcctcaaggagccggttactaacagggagactagtatattaggtggtggcggcaatggttaggagggggaagtttctcgacagcaattgcagggtcagtgaaagagatacttgaggaagagagaaagaaatggctctggtggtttatctttcctttttccccttccctctctctcacactattaattatgacatcacaagtgggaataaaagaactagagggaatccccagtaaaagacttcacatagccacaggccaccagactgtggcagctgtccctgaatcatcatgggtcagttggtaacgacctgtattttaaccctagatcacaattttaggcccagcaaaattgttctgaagctgtctagatttattaagctatatttatattttagtttatgttaatatgaggttgagatccaagaccctgttttctccagacctcatatgagtacagtatcttaagttagaatttatctctctgcataaaaatcagacctagtgcgtaggcttctggatctcagaatcacttatacttaagtccaggctgttctcaaataaggcaagaagcatctgctgttaatagctgacagtaaattacacaaagtaaaacatggaaaattaaagtcagaaaagctaggaagcttttctatcattttcaattttctgcaaaaatacagacataatcagtgtttaggatctgcttgtgatggataaattacatctgtaattccttcttttccatattactgcattcagacgataatttgctttcagatatctttgctcatctaatcgttcatagactggaaataagtagtaacatctcccaatcctaggaagcatttataactagtctttgcctttttgggtgttgatagactagtggtgattataagctttcgagcttctgaaaagcacaacgaagattaaaataatcataggataataaaatactttaaaacccttctagtctttaattttaaaatgttccagtagaacacaaatttgctcaggtaacacacaagtaagcattaaatgccttcctgtgtatctgagaagtttgttatgaaatattttggaaaccgctgcatagtcagtgtaggaggagcagatgaattttagctgtggttatgtgtgctgtaaaagactatacgtgcttgtattagtcagaatgagtacaccactaatttttgtatggtaagagatttatactaagctcatcatcagtttctataattcagtgagataaaactgagtcagattgatttttaggtagcacatgtagaaacagctaattttattcccctgatttgatcctcatctattgattatataaactaaagaagctaagaacaattaacccttacgaggttacacagtcaggagatgctgaactgagattcagtgtagaaagtctgtcttcagagcctatgcttttagtctttatgctaagtttaacttgtttaaatagcaagattatgaagcactatacagtgacctcgtatagacaaaaatatagtatattgattattagagaaactacatattagactgttgtacatacgtgggcaagtatttgttaaatcatttcagttgcctaaatttaagcaactgtgctgtttaaaacatgctcattcacattttttcttaatctagaaagtcacttctgaataattgcttgtttagattttctcatttggtgtgggaaatttatattaaaattttaactaatattctaacaatacagagtctgaacctaaagtccagaagaattttaagtcatgccgcagacaggatgaacagtatagcaaatcagaataatagactgtttgggggggttggggggaacccatgagaatttcaggatttcaagataaagcttggaattgaggtaaaggcatcagataaggaagtgtttcatttcataactttttttttgcttgaaatataatatattttaaatcacaaaagtagtataactgttatttttctaatgcacagaaccatgagactttttttttttttttttttttttttgagacagagtcccactctgtcgctcaggctggagtgtggtggtgccatctcagcttactgcaacctccgcctcctgggttcaagcgattctcctgcctcagcctcctgagtagctgggattacaggcatgcaccaccatgcccagctaatttttgtatttttactagaggtggggtttcaccatgttggtcaggctggtatcaaactcctgacctcgtgatccgtctgccttggtctcccaaagtgctgggattacaggcgtgagccactgcgcccagctcaaggcattattttataagaggctgagattttattcatcttactaggcatttatttatattatattgtttccaatatatgcctagtaagacagaaatatgcttaaaaacctttgtaaatctttacaagttgtactatattaagttaaaatccagatgaaaccattcaccacctctttgacaatgattcatatatcttattgtatgtcatgcttgtttgtgattttgagtattacatttcagaaattttctaggactaaaatttcagtagtttattttaattttttgtttatttgtaataattatcaataatgctgaaatattttagatctagtaggtagaatttttttcatgtgaatacattaattttaatgatgtatttaaaaatagctcacactattctttttaagacttttgttatatgtaattggacaaaaatttgaccatgtaaatataagaatcgttgattctattttgttcatgatatggcataaagagcatgtttgctctcaaaaaacatgggtttgagaagatgaaatttctgggcatactgggtatttagtagctatcagattgtaatcctgaactcttaagagatgtatctcggatgggcgcggtggctcacgcctgtaatcccagcactttgggaggccgaggcgggcggatcacgaggtcaggagatcgagaccatcccggctaaaaacggtgaaaccccgtctctactaaaaatacaaaaaaattagccgggcgtagtggcgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaagagatgtatctcaaatattagaattgatcatgttatttaaaatactccatgggaaatataattatttttatggaacagttcatttggatgaatggtagcttgaacagaaactttcgataccaatagctagtgttataagtgtcctttcctgaaactcttgccacgcattgtgttttggcgattttcatggttgtacgaatttagtcagacagccaattagaaatatatttttagaaaattaaaaatgaatttatgtggattcaatgagatcagttgggtaaatcccttaattcagtgtcatgctcatgtaaatactccataaatggtagccattagtattgattgttcttatctgaatgccagagtttagtctaagttatctttcttcttatgggaggaactttgtcttaggtcagaataaagattgttatatagattcaaacttggtatgtaattcaaacttattttatgttcaagactaaattgatcatagggaaaagtgactggtgttccttgtcctttcatttcatttctctggacgctttcttcattggtttacattagctatagtgtaactttttattgtgttttggtattttctgagtgtctagattggcctgtatgctcttttctttgggatgaaatttgtaataaaaattattttgtagcaaataaatactggcgacaggaataatgacaatgtgactaccagtggttttcacttcattcccagtgtcacgtttagaattttcatcaaactaggatcttcagaataattgcaaaaagccacatgaaaaaatgtgcaagtgaaaacttttttttttttttgagacggagtctcgccctttcacccaggctggagtgcaatggcacgatctcggctcactgcaacctccacctcctgggttcaagcgattctcctgcctcagcctcctgagtagctggaattacaggcgtgcaccaccacacctggctgatttttttttatctttaatagagacagggtttcaccatgttggccaggctggtctcaaactcctgaccttgttgtctgcctgcctcggcctcccaaagtgctgggattacaggtgtgagccaccgcgcccggccaacattttattttttatggcaaagaatcaagactttgttaagagcctaaaccgtggattcagctggatctgagtttgataccatagtgacttcctagtgacattgtgccaatcactttactgtcccaagctggtttccttatctgtaaaacaagtctagtatcatttgctttcaagatttgtgaggattcaatgagatcagttagatataaatcatttaatgtagtgtcttactccatgtaaatactccatagatactaacggtagccgtttgtattgttcttatctgaatgacagagttcagtctaagttatctttctcttatgggagaaactttgccttaggtcatagtgaatgttatttgtcattatgcacattgcactacaggtctctgtgttgtttgaaaaaattaaaaaggacttaaccttgaatgtatataagtgtgcacatactagcttatttatttacctgttatcaagagaaaataaccccttaacctcttaacatatgtatgacttgactactagctaaaccagtaggtattaatggaataattcagaatttatattgtctgtacctgaaaattcattttgtaaatgcagttaagtatgaatggaaaaatggttgtagccatctgttagcaaatctaaattcatttaaaactaatcctatttagctttatgctggtctacaataaataattcatacttgatatttcaaatgctgtattatttatgtaaattttctcctaaaagactcacctaagacttttctagaaataaaattgtttattcagcaaagtacctgcacagattagaaggttaaatattaaagtttattttttcatgattgcactattcttttctatttttttatacctatataaacttaattggtcaaatatctaccactcacttcctcaaatgtgtaaagaagcatccaaatccataatactctgtttatcacagctttttttttttccccctttcactgtcactcagaatcgatagggatccaattctagcctgttgaaatggtccgttttgctccaagactttttttttttttttgaggtgggagtttagctcttgttgcccaggctggagtacaatagcgtgatcttggctcaccgcagcctccacctcccgggttgaagcgattctcctgcctcagcctcccaagtagctaggattacaggcatgtgctaccacgcccggctaattttgtatttttagtagagacagagtttctccttgttggtcaggctggtcttgaacttccaacctcaggcgatccgcctgtctcagcctcccaaagtgctgagattataggtgtgagccaccatgcctggcctagctccaaaattttaaaaagcatttgcctcatttatgagtttgagacttttaacatcattagaaataggagagcatgtactttttccagcaagtgtaaagggggaaacaaacaccaaaaccccatctccctgatttttttggcttttcagaaataatacagcctagtcctatggccagttctgggtttttcttgacagcgtctgtaactgttcttgttatagtctaattctgggtatgagttatgtgtttacagtttgatttactgagccatgccactgcattcttgttaaggttattgattattgcccattctgttctgctgtgtattattgatttagtgtgtgacaatgagttaattgtattacttgatgttgaagaaggatcaaatatctgttcaaaggggatgcttgtagcctgtgtaattgagttggctatttcaggcttttaacatgttgtgaaacaattaggagaaagtacaggaggacctctgagggcagggaacataaaatttgttttcagctttttcgcagttgccaaaaatggtgccgtaaggctttcctggaattaagtagtcagttggtatttggttagcagatgctttgtaaaacctaatatattcccactatatttcctttaaaaatcaagggggggttaacacctttagattgtcatgttttattgagaaaaatccacttctctgaaactccctattactggatataagaaaaaataacaagcaagatgtgttgtgtatgttggtgcccacattttggaggaaattacagagatagaaaattaagctaaattattaagaatctgatgagttctttttgcttactacagttttgtttcgtatttgataaaaaaatttccatgtaataacatttaagataaagccagtattattttctttgacattattttgcagtttgaattttctaagctttagacaattcacacttaatgtaaaaaaaaaaattaaccttcagaatgagatcatggtgccatggttctctaatgaatgttaccttttgttttagcagctcagttggctctaatccatggaaaagtttttatttcccatcagctccaaagtaggagccaaaccaaagtttaaagaaacgttttccagcagacaagtttctacagataatagtgaaagcgtgtgaacacacacacacacacacacactctctctctctctctctctcactcctctctctctcacacacatatgcgcgcgcacacacccacacgtcttatggaaatattaaatcaggaagaatttctgaagttctcataataaaaataactgtaatattaataaagtactccttatcagttatttctcgtcacattgtggccccaagggtttgcttgacttttcaaaatgtatttgcttcaggataaattgaagaagtaccactctctccctgtattaatacctttcagggcttttgatctgtaacctcttgtcacctctggtttatctggcttagcatatgaattttgaagaatgagggagcataaacaattatgactgccttttaaaaaatgcacgttaaacctgcggcctcaaacttgtcagttctgaactttaacagtagaaaagtgaaaactcagcgttgaaagtagagagtgtaagagattttgccagttggaccactttgctgcaaatacctattagacccaaacctttcttttgcctagtgatcagctatactaatagcaagatccacttaattccatgtgagtcaacagcttgcatggcatgcccactgtgtgcaaatagcttctcaggtacttttccaagcgtcctgcctgcacaaagcagaagagacttggaatatatttatttattctctcaccccactgcttgctctatcacctagaccttcatgctccatcacctagtcctgcttgctccatcacctagttggaatttctaaatcaacagacatgggcagatatatattttaaaagctgtgtgcctctgattaacaaccattcctttaatactgctgagaggttctgggaacatagtatttttgccatgacttctcaatctatagagaagatgtatttatctcctaaggataaaaccatctggaaattttcacatgctccagactttcagatagagctggctttgccttctctttttcttcctcctcttccttctttttcttcttttatttatttatttattttgctttgcttattaaaactatggatgaatttttaaaaagattaagaagataaaataaccttctcacctgcttagtaatttcttattcatagttagaaggtacagtaactgtttcataactgtccccattaaatttctgattcaaaaaatatatatttttctttataaataccgtttcctatgatttttggtccctaaaaagcaaacaaaaaaaagctacttgatggtaccttggttgtagttagcaggtctccattttctacagatcttccattctgctttattaacttcctttattaatgacaaatcagccagttgataaaataatgtgttaacttttaaaagattcttataaatttatgtggagttctgtgactacctgatatgactttgtgactattttagttgtataaagaatttcaaattatttattcctttaaaaaaatttttttttcagagacagtctcactgtcactcaggctggagtgcagtggcgcaatcttagctcactgcaacttccacttcctgggtttaagtgattctcccgcctcaatctcctgagtatctgggattacaggcatgcaccaccatgccgggctaatttttgtattttttgtatagatgaggtttcagcatgttacccaggctggccttgaaatcctgagctcaagcgatccacccaccttggcctctgaaagtgttgggattacaggcgtgagccaccgtgcctggcctattttttgttttatttttttaatcttgaaataactccacagttatctccaagtaagtctaatatcttctctttgaatttctaactgattcttatttataaacccatagaatctgtaaacccacaaacaaatgattcttcatcgatcaagttctgttttcaaatagatgttcaacgagatgttcaaaaagacgataaaggatacattgtaacctaaggactttatttcgttcatttggtcatttaccttttaattgtagtggacttaaatgtatacagattttcatgtacaacaagtagtatcctttagctgcaacaaatgaatagattagcctatgtgaatatagttttgcaaaatattaatgtatgaaagtagtcctaagactgcaagtactgttgctttagaacttcatgcataaattgggtgtgttgttacaggatacagagaaaattgatggtcaaccttagcctgtagtatattttgacagtgtgaatgagtcaagcaagcaattttccagactgtttaatggtacaaaggaaagggctgctaaggaagtcattcttatgactagctgaaaaatatttttcttagtgactgttctagagaaaaacaggtcaccgttggaagaaaaaagcagtctcacgttacaagcattttgaaagtggtttgatcattaaaatgtatttatcttacgacaaaacttaaaacggatactgcttactatatttgcaatgtcttgaaactcaacaagaaattatgtagcatcattacaagttttaattcatggtagaattttggagattatatttattgagctatgttttttatttcattagtacaaataaaactgcattttatttgttctaatgataaaatgttttaagtttataaaattactgcaaatgtattccactgtgtggttctaaactgcatttgaattaaaataggacttgattgatggagaatcatttgtttgtgggtttacagattctcttctaggtagtttgaaaagattcattgtccagcagcaactgttcacccagagacatagtgcttagcatgagcttgatggattcaaaccactgggtttatcattactacatagatctttgaaaagacaggctgcaaatcttgtttctaagctgtgactagctattattatgtcaatttgaagaacagaagtaaaatcaatccagattcaaaaaaagacactctacagtcattcacagactgcaaccagttcaaattgtaatatcctgcctatttaaagtcccctgattattatgattattcaatatcatgttaatatttaaaacttggaatacaacctactaaccttatttttatttgtactactggaagttcctctagcatttttgaagtagcttggaaaaaaattgagattcagttgtggttctacttacatttttactagagtaagttggagagacaaatcagtgagtagtcaagtcttcatataatcaaagcttttaaaatatgataacaaaaacttcaggtgttagatttagcttcacggaaaacctttttttggggggcctaagtttaaaatgtgttttttctttgcattttaaaagattgcttgtgcagtgttcaatggttttgtttagcatttagagatgattttttcctttgtcactttccacattgaactctgctgatttagtgtgttagaattgccgtcagaagagtccttagaaatgatgtcatgcagttcattagttttacagatagggaaccaaggagtggtgaggttagggtttaatcatatccataaagatcttgaggtcattaggaccctttaaatgtgactagttaaatcacagcaaaaactagaatatattgtcttcatttcaggaaaatggcatcattgacacacctgacagatgaaaactgctattaaggtcgagtccaagtgacaaaactttcttgactgttctgaggccttggttacggtggcattaaagttctatactgtttttttttttttttttttttttttttggctggacaacagactctccaaaaaaatgcatgtgtatacattatgcttattataaaatttactaataaaatgacatggaagacaattaaaattataataaaatatacaatgctcaacatttaaattctatatggccaattgattcttacagaatgcctttttgatttttgtccaactcttgcatctgtagtcaacctgtggtcgcaattgacagaagagtttaattctttctttgtgctcttactcctgggtccctcattgtacagtgatcatcaaatgcaacatccttcatgaaaatgaatagcttcactttttggcatttccttcctttttatgtgtcatagaatacactacattattcttgattttacagttaatttgtaaattgtttctaacccccactagtttataaactccttaagaatgagaagcttgcattaatcacttctatatatatagtgttttgaatatccttggcattcattaaatgtttagtgaattgaatgcgatgtttcttccagactatgaccaataattgtgagaagattttatgtgtttttaaattcaactttagagaatttctttttgtgtaataggacatttgttggacagcaacatgtaattactcataaaatgtttctctgcggagtccagcatccttcatttgtgataggactcatccagttaaattgctcaggcactataatggactatttatgttctgttgatgtaaatttctagaacaggcctttccctggactcatgccatgttttgtatgttatcttgtgcaggcagcacatggggacctagtcaggcttcctgatatgatagctgtatatacagcccatgtctcagaggggaatgataaattggcctgtgcagtgacacaatacacagttattttggtgacagtattaactctcttttcataagggtgctttgttggaaaactattcagcttaacacagaatatttagctttcaaaggttgcatagggagaaatgatactgccaggatagaaacattatcagttttttctttctttttttttttttttaatcttttttgactctaccgagaatattgaaaagagttttgattagtattggtgtttattacgagaggaacattctgggaaccagactattagtataattattattgtttttattatcaaactaatagcactaacaaggacatacggtatttgtcaagggattcctatatctctgttacacctaaatttctctatactctaattttagaaaaaaagttttgtcttccaactgtgaatactttatagtgttgcaacttctgcttctaatctttaatctgaagtagaaaagagaatccaagcttccaagaagtatgtctctagactctgccacttattaacttgctccttattttttctctccaacaattattttaagatctgtatgatataagctatttttagaagaactgaaaagttctagagagtaaaaaaatgttccagattgtgtgttggtgccagtagtactgacaattaaatatttgattgaggagaaacctacatttatccactttgaagaggatcatcaggggagttaaaaatttagtacttcaggctcattaagagttagaatagagtaattatgtagctggtaacaaatgctacaatcaccacttgagcattgtgatatgttactcattgagacttactggccttcttcagggaacttcagattttataaaagtcatttgcttagagagtaaagttctgctaatccattattttagttctgtcatctttttctgcaaatagggtgagttttccgagagggtaagtccctggtaataatcttaaaaatgatacaactttacagaatatctccccttgccatgaagcaatacttaatgtcttgaacagtgagcctcttgttcatgcagcatttaaaagagatgagtgtagaggtcttccttctacattcattttattcgttagtaattgagaagcaggtctaattttctaatcttgcaagttgggaaattattaaaatgctcaagagacagtagatcaagcctggtgtccctttctccatcaaattttaaaggatttttttttcctcagtaattctgcctttgtgtatttccaatcttgcttcctatttgcattgcacacagtggcatgtcaatttcaaaagaaaatgtattcagatctactttcaaactaactgaaagagatagtggtatttattttatcctgaggttttgttgttgttgttatggttgttctttgttttttaaatctggacatatcagtaatctcctaagagaatctattccaaacacagagactgtttattcttgttttagatactgttttaaaagccaggttatgttattatagtatagatattttaaaaaataatgaaaacagagttttttttaaccatatttttgtactgcataaaaatgcagtgacaagagaaaaacattagaactctgtcatactcctaatatagaccattgctgttaggtttctaactccatgttccctgtctggaagctttataaggccgtgccttagtcttcttaagcctaacacattgtagccttccaataaatattactttatttgtattaaatttaaaatggaatagaatgtggtacatcaccagcgttcatagctcctgacccatgccataactttccttgccccatccccaagattaaaaaaacacaaactattagactaattatagtcattacagttgtaaattaggtcatgcatttcattaaaaattgacgcagctccctttttgaaaggctatgtcacggaaatgcaaactagccttgtatatagaacactaaaatcatttaacttgaattattctaattacgataccacaaagattaaaaaatacatctatattatctcagtctgataactgggctgggaaaaaatgtcagttttgatatgtaacaagattggtatgagttattttacgtgacagttttattgattgatttttttcatttataatcactaattttgtgaggttttctcccctgcagcagtggactgaaaaagttaacatttttctggcattttttaagcgctaagagtagaaatcaatagttaaattgacctaataaaagatctgtgcatcctactactgtgacaagaagagcaacagaaagcaacatgtatagactcttaacaaggctcaaggcacattttggatttgttttgcatatgaatttaataagcatgagacagtgctagtgaattacatttgttttattgagtctatttaagccaggatactgttaagtaatagactgacggtttgtgggagccagattcagtaacaggtcagcaacagacttgccacatgccaaaaatggggttatactggtttcagtttgctaactgcctaagtaaacttgtgtagaatttgcattttttgctttgcaattactggttacttctctttaacattacatttgcattctatgtaaaaaatagattttatatttaattcaaaatttatccaaatgtacttactcattggacattatttttaaatgataaaggaacttaaaaaagtgataggatcaatatagtaataattctaactcccttttatacccatataaaattcatttaactagacttattcattcaacaatattgttaaataacctaaaggaatttttttaaagaaatagtgtaaacatacaaatatgaataatttgaactcccttttatataaatatatctgtagtcactaactgtaaataatttaaaaaatatatatgtacacacacgtgcgtgcacacacacacacacgtcatgccttaacaatggggatatattctgtgtgtcattagggtatttcattgttgtgtgtacatcatagagtatacttacacaaacctaaatggtatagcctactacacatctaggctgtatagtacggcctattgctcctaggctgcaaacgtatacagcctgttatcctattgaatactgtaggcagttgtaacataatgttatgtatttgtgtatcaaaacatactcaaacgtagaaaagatattgtgttgtgctatgaggttatgatgtctacaaatgtcactgggtggtaggaatttttcagctccattgtaatcttatgggaccaccatcatatatgtgggtcctttgttgactgaagcgttgttatacagctattgactatagttagtgaaaaaatctagttctatgattggttttgttccctcctttcttatgatcactattcattcaacaccttttatatgacatgcagtttgaaagcacagggtatgcaaaaattatccccgttttcggttgcagtatctgttgctgacccagataacttcatttccttcagctgtgctttcattttcaacttctctagttggaaataaatcctcttgtgttgccccttgagggagaaatcgtttagcaggaaatcacttactaatcacagttcattaatcacatataaagaatactttataaatgtcaactgtcattcatagaaaatgtatgttaccttgaggaatgtctatgaattacttattcattttcattgcctttcacacattatattccttaggagtttattaatttcaaatataaattgactatgacttatacagagtcttgcaaacaagagagatagcagttttgcaccttttctttgatttacttgttatcttcctggtcatgtagttagtctgttaaagtcactctgcctgtatagcttgttgaaggttacaggcagtggagtgctggaactggcttatgtcgagacctcttcccaattccatgttcaatgatgtctttgttgatagcttaaaattggctatggtgagagcgtttacactttggaaattggcagatggcaaccatagttctctcctagacaaccacttattaaacctttagcagcactcactgtttatagtgttctttttcgttttttaaaaatacttttattatgaggaatagccatgtagaattttatttccagatattttgttgtttaaaaccctaagaacatcactcactataccaattgccaactgagtaactgggaaagttacttagcttttctgtgcccaaatgtccttatctgtaagacggggatgataataatagcacgtaccttgggattgatgtgaggttgaataagaaacacatttatttcagtgaatacataatgacctggaatgaatactcaaataatgctacctgttatctctctgtactttaattaatagatatttattgatcccttactaagtacttagcattttgccatgtacagtgggtcatctactgagactcagtacctcccacatcaagttattagccacattgacctgtggcaaatgacttcttttgatgttcccatgtaatgccacatacccgcccccccccgcccgcttttttttcatttgtttttgtttgttttttggtctttctgcctgggactcttttttcttcctacatgagttttgcagaccttttccatgtttatatatggctcatacattccctcctctagaaagcttctcctcactctagacctggccacataactgttttgcctctttgcttatgtagtttggagtatgaatcataataattatgtatcttactccatctctgcatttgattccacagcctacgacttacacctttgtgttcttaacctcttagtaagaaatgcctgacacgtagtagactgactagaagtgtacattgaatgtttgctggttaaaggaatggaacatggacttcactcatagagaccttactatttggttgaagagataatgcatacacatgtgacatgaaggtaaacacaaaatatattgaagatatctgtattttattttttttagtttatagttaatttttacatactatatatttttgtagtaggtaagtcaattattttcatgctacagatatggacatttatgtatttatgtacaaatacattgatttaggttatctaggccagattgtaagtagcaaagccctgtttgtaaaccaggttttgtgacttcaggttagaaatattaaaaaaaaaaaaaaatccttaattgctcttccagatatgaactcattcttttttttttttcccctgtgatttctgtcttttttgtttgttaagtttaaaaaatttatggcaatttttaaatgtacataatattagagaaacaatataacaaccccctccatatatctatcagtcagcattttgtatgcatgtatccgtatgtgcatcagccaacattttgccctttttgttacctttcacactccttttacccctgtagcatgttaaaagaagtctcagacatcctatcatgtcacttatacttcttcagtagtatctctgacagttaagaacttattttaaatataactccatttccaaatctatgaaaattgacgacaattttattgtatcatttgatagccactttatgttcaacttttcctgattgtcacagcaatgtccttttttaataggtacgtttttccagttagcatctatggtgtcatttagcttgttcttccatcatccttattttctgtaaactgaaaattagagtcgagtttaactttaatgttatttattattatttggggggaacatttcctggaaggttctgtatactttctatttcatcatatcaagaggacataattttagtaatccctgcttttaatgatgctgcaatctatcagtgaatcagattggcctgggccaatccttataaagttctccatcagacttggatccaatgatttcacctcattgttgatcattttgtagccatgatattttttagagtttgcaaaaatggtgacttttaattatataatttctgctgcgtttattatcaagaatttttttcataaagatcttttcatagtaactaatggtcaacttcaaaatatagtttatatcagaaaaagggaaaaaatgcatgatatttatcaattttcagaatcagatattctcttctaacataagatctaaataagcttacacatataatcaaggatgccagtaaatttttctaaaaaatttttcccttggaaaaattatttatttatttatttatttatttatttatttatttatttatttatttattgagacagagtttcactattgtctcccaggctggagtgcagtggtgcaatcttggctcactgcaacgtctgcctcctgggttcaagtgattctcctggcttagcctcccgagtagctggaattacaggcatgcaccaccatgcccagctaatttttttgtgtgtatttttagtagagatggggtttcatcatattgaccaggctggtcttgaactcctgacctcaaatgatctgcctgccttggcctcccgaagtgctgggattacaggcgtgagccactgcgctcggctgataaattatttgaattgcttctcctaattttttttgattaatatgttttgataacattgttcctatggtaatattatcaaaaaagttttctttccttcctttttgtttatcattaatgtgcctctgtatggttgaatttatttactcagaagatatttattgggcatctgtctttttttatcaagctctgtgctagtccctgaggatgtagatatgagccctgcttttttcttttctttctttctttttttttatttgagacagactctcactctgtcactcaggctgagtgcagtggcatgatcttggctcactgcaaccgccgcctcctaggtttaagtgattctcctgcctcagcctcctaagtaggtgagataacaggcatgggccaccatacccagctaatttttgtatttttggtagagatggggtttcacccatgttggccaggctggtctcaaactcctggcctcaagtgatctgtctgccttggcctcccaaagtgctgggattataggcttaagccactgtgaccggctgcttttttcctagaatatatagtttgggtttcttttccactcgtgatgtgatttaaaaaattgaacctgttgtatatgaatgtggttttgtaaactataatatttggtatcatatactatatttttttctatatatatatatgctactatatagtcatatagtagcatttttttttatagctttctttggagttcttggtcttagtgtctaaaatagtggccataaaggaatttggaagttaagttgttcttgctgacccaaagaaaaatcagatgtttctgtttaggacactgtatgtgacaaacaaggaagtttttattaatttatttttttgaagaagaattgatgagagaataatgagaattcctccaagattaaaagtaaattataagatcctgtgctattttaatgtaagccaacatttgaatttaatttgacttctattttcagtaaattagagtgaaattttagggatgtctttatctcctatagtgtgtgttttgccaagatttattaagggtaattttggattttagaaaatgtacagtttctaaaggcttgtgaacgttttatattgatagaaaatgtaagtaagactagtaacacattattttctccaaaggatcctgtgactgacacaaaaaatatgatataatattgaatctgccaaaagatgcactgttaatctagggttatgttatgttgttattttattaggtatgtgatactatggtgtgaattttagaatataggtaattatttaagtaattactgtaattctaaacatcttctgagatgttttctctaaagcagaaactcagcttttactcatgtttagataatgtgatatagctgttctagatatttgagattagggttgaggcaaattgttgacatataattaaaatgtattttataactaaaatttagaagaatggaaaaagtttacattgtatttataagactttgctaacatgctttatgacattacggagaagtactaggaagaaggagatctttaaaaggagtgatattctgtttgctttgctggagtaccttatcaggaaatttgaaatcttagccctttaattgtgatatctgttaattctaaaacttacactgaatttaactttgaaggtcaacatatggatttttttaaaaacaatatttactctatcaaaagattagttgtatttttgacttgaggaaatagcttaatctgaacagcacgaaacttgacaaaaaagtttgctaatacataaatattggctattttaatctgttgaaaacggaaggctagtaccaagggagacggtagtaaaattatagaaggagctagtgaaaagtaaacattatgcaacatgaaaagaatactaggggaaaaactgacagagtagaataacaggaagattagtcacttctggaaggaaaaaagtaggtaggggcagggggatgaagtactttaaacaggaatgtggaactggaagtgctagggctaaaagacagatgtgagcttatttgggagctaaactgggctttgaaaaaggaataatactggtagcatttaatatcaaaatttaaattttatgttaacaataagaaaaaaatggagaaaaatttttgttagggattataaaatgcctgttaaaataaaaagacttatatttactcctttgtggagctgaattggtttcggtcagacagcaatgtcaaatgcaaatcaagaaaatacatttctgaggccaaggcaggagatttcttgaccccagaaatttgcaacaaccccaaggaacatagtgagactctgtctctaccaaaaagaaaagaaaaggaaaagaaaagaaaaaaaattagccaggcatggtggtgagcacctgtagtcacagctactcaggaggctgaggtgggaggattgcatgagcttgggaagtcaaggatgcagtgagccatgatcagccattgcactccagcctgggcaatgaaacaagaccctgtctcaagaaatatacatatatattttatcttatatatatatatcttatatattatatatatatataatatatatgtcatatataatatataatatatataagaaatatatatataatttctttcaaaaccggtcaaagttcttttactttcaagtgatggataaaataaaaccattgtggatatcatgggatatatgtgctattggtttgaaataattttcacttttgcatttatttatctgacaaaggagtaccaatctctaaatattttaaggattatttctatgaattctctaaaaaatataaattgtaactgtctatatcatacaaaaatatttagcaatccttataacagaaaacaagatagtaaacattgtgtgtatgttcatgtgtgtgtatgtgtgtttattggtagtctcattaatccctagtctctactgacgttattagggacattagtggaacagattttgctgaacacattttcagccactctgagtgttcttaggtattttatttatttagagactgaatctgtgttgtcctgcctggtctcaaacttctgggttcaagcgatccttctgccttactttcccaagtatctgggactacagatgcacaccactgcccagctaaaatgtactttaaataaagtagataattctggggttatctcaaactcctggcttcaagtgatcctcctgtctcagcctcccaaagtcctgggattactggcttgagccactatgcttgccacctctggggttatattagcatgacaccaggacaaaaatctgcccatttttatatcaggaaaaaaaatgctactttcatttaggtgcagaaaatggcttatgcctattgaaataaaaaattcagtctaatttagacacctaagattattatttgctataacgacatggaatacatcactgtgtgtcactgaattcatggaaatgcagtacagaatgcaatacagtaatccccccttatctgcaatttcactttctgcagtttcagttacccatggtacaacacgataagatattttgagacagagaaaccaagagagagaccatattcacataacttttattacagtataattgttctgttttattatagttattgttgttaatcacttactgtgcctaatttataaattaaactttattgtaggtatgtataggaaaaataatagtatatttaggggttgttactgtccatggtttcaggcatcctctgggggtcttggaatgtattccccatagataaggattatctactatatacagtcaggtaagccattcccattgattttattacaaattgcagtgcttccatggcttgcttacacataatttgctgaggtaacttttgcagaaagtaaccattttacgtgaacaccaaatactgattaaaaaaatctctttttctccttttccctctctttctctcccttctccctctctccttccctgtcttactccctcgttcctgctcttcttctcttttcatactcacacagacactccttcccctacacacacacacatacacacatacacacacacaccctgcccctgggcataactgaataggaaatgtttattttccaaactacagaaaaaaaccttatctcaaacactgaaagtccttccttttcctggtttggaaacactaagtcatactgagtcacttgtagattttctttagccagttttatttaaagcataaagttgtgaggacaaaatgactcaggaatttgtaatgtaccattagagcttttcacttttaggatgctagttcatattcagatgacttagtattaaagattgatgggttgtttactttctagaagaatctgaggagctcactgtaacttcacttattttgacctaagtatggcctagagtttatgcttattaattcatttatttctcggtaaagccatgtccaaggaattaaataaaaggaagcggacccagtaagggttgatgaataagaagctgttaccttactcatttacatgtattacttcaaatgttattgattgattgattgattgattgagatggagtttttgctctgttgcccagactggagtgcagtggcatgatctcagcaacctctgcctcctgagttcaagcgattcttcagtctcagcctcccaagtagctgggattacagcctccccactaccacacccagctaatttttgtatttttagtagagacagggtttcattatgttggccaggctggtcttgaactcttgacctcaagtgatccacccgcctcagcctcccaaagtgctgggattacaggtgtgagccaccgctcccggccttgatacctctttaaaaatgaagtttgttaaaatgatcagaaactttaatgcagctgattgcattgccattgacatcagtgagaaataaaaactatagctataatggttaagttgagcagttggaatctgtatgtctgtatctatctatgtttatttagatgactggataaaagagtcatgattcctcctagtctatcacgtggtaatgccaaggtcagaaaaatcatttgttatgatctatcttatgtaaaagcctgtggagttactttgttttcctcactcataagatgtcaaaatgtgctttctagaatttttgaataatttttgcttaaattcagtgttaaagttggagactgaaacaaatttaaatctgttgttagccaaagagtaaatcaagcttatgtgggtgcaatatataacatgactacccaagaaattctgcaaaaaaatgtagttgtctagcaattaggtacagagttgtcatcttccttctatgataacttttgattataaaaataattgaaggtaaataaactgtaaatgacacaccacctcaagctatgccacatgggcacctaaataagttctttttagtaaatgccaccaaatggctgtatttcttacagcttatggctaaattctgacagaggggaggtgccttcaccataagagtattttctctttgaagttttcatggttttgtgtgtgtgtgtgtgtgtgtgtgtgtgtgtgtgtgtgtgtgtgtgtgcgcgcgcgcatgcgcacacactagtttatattaggttagagtttaaaaaaagctgaagatagccaaaattagtccagagagttagacttgctgccaaactaaagaaatagcttggtttcagtattcttctggcttctcagtcttaacatttggggacctgagtgcttgatttgagctgactgaaattaacccagatggcccactttgggtcctcaagagctaattaaaggaagtcatttcagttgctgaataatcaaggccgtaccttcctccaatgttggtttcagcccacaccttacagatgatcgctggctttctgaagctctctctaaactcataattattgtttggaccctgcatgtaactaaattaatttgccaaggatgggaatgaaatgtaagttttattggcaacaatggtaatcccccaaaacagaatgacagatacagtgatggtaataatgttactgccctgttaatgcctccgaagataagatacacttgaaaaataatgtgaaaactgaatttgtccttgatttgaaaaatctgagaatcacataaaatgtttgttaatttcttaagctggtaaatatcattaagagaaatggacacatataagataagtttgtgtgcatatttgtacacagttaggtttttggaaaaagacagggatatcagatgctcctgccaccagggttctggccaaacacgacatttcctactcttgtttttgaagagttctaacacttcatcagttttcaagtgtcagtagagagtgggcataaaaccacaatttcaggagctgcattctctgggtccagatttcatctttgctacttattagttgtataacttttggcaacttaacattatatgcctcagatttatcagatataccctattaaatggcaatgtgtctaccttgttaggttattgtgactcttaaataagttaatacatgtaaagaacttgtggaatttcagggcacacaatgttaccttaccattgatattatttgctgttattaaatcttaattttatgtaaacattttaaaatgtctgtctcgttaacaataaatgtgcaatatacaaataaatgaaaatcaaaattagtggtggagttttaatgaaataatttagagctccagctctggaactgtataatcttcattcaaatcactgtgaccttgaagaagttatgtaacctaactaagcctcagtttccttgtttccaaaatgggagcagtactaatatctaatccttagaggagttgtgaaaattaaatgggataacacgtataaagcacagagaacagtgcttggcacttaatgagtctacagtgtgtgttagctattgttttattaattctgtcatgatgaagtgaacactgtgatgcaatacttttatacttagaatctgcctatatagggttttcagttttgctaatgaggagtgttattctctgctgtgtaaagaacacatgctttggtgtttataatttttctctaataggtaaatgattaggaaaagaataacctgttattttacttatcctttgttgagatatttaaattatacaaaaaaactgtagatggctttttatatctataggattttagctctggataaatcagttaggtaaatgcattattaatgttggaacctgcttaactctgttgtccagccacattgtagccactggttaagtcgaacgccactagaaagaaaagcaaataatcaaaaacatcaaaatggaaatgaaatatggagcaaggaagtcattacttctgtaaaataaaggtctgagacctaatattttcccattggttggaagtattgattatgaaaacattagaattttcagtaaaattgtttctgtgccaagatggcagatagaatattatgaaagaaatgaccaaaattgcatatgacatttattttatatggtaacattctttctttcattaacaggaaattttagggcaattatttgcttattgggaatgagaaggatgaatgaaaatttaaaaaggattcatcaagtcttccttataataaagtaaacttttaagagcatgtttttccatagaattagaaacttagaatttcatagtaacagtgtattcatcacctcgtttggggagcagattttcagtatgatcacaggaaaacacctgttttgacactctgaaaaaggtgcagacgtacgggcaaactctctgtaggtgtaaataagaatgctttggctagcatcctgcaaggagatgggtctaaatggtctgctccagcttctgctgctgctgctgctgctaatattgctgggaaggaaaagtggctgacctggcatatccattactcttggtgctgcagcagtcactcaggaaatgttgtttaaggggaaccttctggatccttttcatggcaccatggcaagaagaagctgtatcttatctatggaagataaagcatggagttggctaatggatgctggtgagtgaataaggcaattggggagccagtttgctaagataccatttgggtaggcctgctcgctcaaggcctgagatgacatccatgggaaatggcttttggtattctgtacattagaaactgttttagagaggaaccgtggttttcacattggtgatctgatctgtgattctgtatatgttccataaagttctcatttattctctgcttcactacttgaaatactaatattgaagtttgttcagtacttcagtagatggagcatagttttccatgtaacttcttagtcactaatctctactcttgtttttgacttgccctacagtgatttttaaaaataactctgtggtatatgaaagcagttgttcctcctttcaattctaattgagcaccttttttttttcacaacagtagattataggattttaaattatcttcccttttatgatttacatcagacacaaacatgtcaatagtttacttttgtccaattaaaaattggaagaaataagaattttaagttaatcatagagatgtaggtcaaattttcttagaattattattctgtggttaataggtatcccataaaaacggtaagagctatgtttgggaacttacagtggcatagtaaaggttctgccaagtcatgggggaacagacttgtttaacttcaacttttaacagattcatttgaccaaccccctctcctcaactcttcttttttcatgaagagtgcctttccacatgtggcactaccggacagtaagtgtttattgagcacctactatgttgctaggcaaactaggtgctggaaatataactgtgagcacattcatcaaaaatttttccccttgcgatgcttaacaacagttatgaaaacctttgtttagatgatctgatcttatgtaagatactttaataacaacataatttttattcaaaaatgtaatctgaagagcttcataagtgaataaacctacaatttctgattgacaatgtttatttacttctcttccacttttttgggggtttgtttcatttttgttgtttagattgttaaaaactggttttcaccaatgggattaagagcataggtgcagaatacaaactgcaattgatttttaattttttatttaaagtcaaattattacctttaaaaaaaggtcagcctccatttggattctgccatagaggcttacacaatctttctgcattcaaacctatcacattgacatgattatatttttaaaaaattaagtttagtttaagtcaaaatctaaccttaggcactgtctctaagatgaaaaagtatttttaaaggaaaatttagattcctcattctcttataaaatcccagttccctcaaatttaaaatactaactgcttaggcagtacttaacatgtcataaggtgggagttacttcattttataacaatgtctaactcttagtgacttatcagacagaagtaaaccttgcacaagctatttgatagcttttatttcctgtgtcacttagaatatatattttgcaggtgaggggagaaatcaattttcccaacacaggatagtttgaaccatttgtctcaaagtaaaatagactactgttactattttagttaccttagaactaaataccttggaatagaagaaattagatatccgaagtcaagaattacacacacataactgcttttaggcaatagcttttcttcttaactaattacaagtataaagtccatggttaatttgcttcgagtcttgaaaaattgagagttcctaaatgattttgaccattttcattttcatttcatacatattaggaattattaaagtcctgtcagagtttatactgaacctctgacttgattttatccagctcatcaaagcaaaattgtcttagtagcactcttttgtagctgtttaatatttaatattcagtgggctccttaaggtgagttcttgaaggcttgtgagtagttgaagagctgtgaatggtggttaacaagctattatcatctccttgaaaagcataacatgaagcagagattcaggaaaatcttagacagtgattagtctatctgacagtgcatcaaaactaaattagttggccaagcacggtggctcacgcctgtaatgccagtactttgagaggccaaggcaggtgggtcatttgaggtcaggagttcgagaacagcctggccagcatggtgaaggcctgtctactaaaaatacaaaaattagctgggtgtggttgtgcacgcctgtagtcccagctacttgggaggctgagccaggataattgctcaaacccgggaggtggaggttgcagtgagccaagattgcgccactacaatccagccttccagcctgggcaacagagtgagattccatctcaaaaaaaaaaaaaaaggaaaagaaacaccaactaactaaattagttatattttctgtccttcctcttctttatcctttttctttttccatcttttgttcttctcatctctgcactgcttatctacttgcttcttctttgtattcttctcttatctcattgaatttcttccgtctgcctcatctgatcataacagaaagtgataagtttgataaaatgtatattgtacttactaaaaacaattttaattatttatcaatttaaaaatcagttgtttaaccttctctctgtctttccgttttctcatctaattcccaataatgttgccttttaatttctgctgccttgcggatcagcaccctgggattttttttttgtatttgtaaattaaatattgcgatgacaagatataataattttatgtcacttattagatttttaaccataaatgccgtaggcatgctataatatgtattccttacttttctttctagaactaaatctccatacccacttcatccgtgtttttggcttatgtatgggatgctagaatggcctatctccatgtattttgttgcatttctccattgcttcttgtgttctggcgggaatcttggtgattcttttcaagcactacctgagctctgtgccaattgttcctcttctcccagggtgttgtgctgcgtggtcatgtctccacttccttagccctgtccattgacagaaccttgggttctgtgatggctgcctctaaacccttgtgaaagcggggaatattcctccccctgctgctacagttgagcaccgtgctgggtaccatgttgccctctacacttgctttcagttgttaaggcttcccaagctttggctgtggctcagtgatcctgctgtcaaaaccctgaaactttcctagcctggacactcagtggtagcagcaggtgttgggatttctccaagcccctaagactctgggaggaagagaatggctgtttgacatagacctcaggagttttcaaagcaccaagaaacctctccagaagatatgtaaaggtaagattctgatttctctaggaagccgttctagaagctaaaaacaaaaccctgtagctatggatttaatataagttagtagttaaagaatgtccttgggaaactctgtgtttgatcaaaccaaaatatgagtcttagggaactatttattaaaaactcttataggaattttgtgtgagattcacattagttttatttatattaaatttggcatggaacagatttttaaatattcaattttttttattcggactctgtgaagcactttttcacaatctgcattgtatatctagtaagagaaatcttgttgagaattaaaatggttaaagataaaatagaaattattttttcaaataccgatgttttatttgcctctgtgttaatatttaaaaccaaaaacatttaatgaatatatcttcaaattcttcaagctgaaattcttaaatccataattaattcaaaaggaattagaagagcagttcaaatcttagttggtagtgctagggatgcattactgtcctttgtcaaaagttactgcttagtattctaactatggtgatttcttgctttatttttagattttaaagggaaaaaaattaaaataaaaaaactttttgggaaaaaaattcactacatatggatataaataacctgaatggaggatacttgtggagaggtggtaagggtgtgtgtgtgtatgatgggtaggggagagagatcagcagcatcttaagttaacaatacaaaacacctcttcagtgttatgagtttgtgacagctgttattcagtgcccccttccttttcttttttttcccccgcctctattttcaggcagtaatctgtgaagtgatattaagacacctcttctaatatgagatcattgttggccttactgtcagtttaggtcttctttttttcgcccatttgttttcttttcaatattaacttaattccttaaatggtttccccttgttgaaattaacgctattagcttactaccacattggagccctttaatttcaatggccaaaaatgcaacttaatttttaaaaatgaaggaaaatgtttactcatagctgaacaaaatgaaaaatattgatctttgacagtgtttattaaggatgctttttatttttagtaaactttatttttattgatatttcatttaacataatttcagagtagctctgtgctgtaagatgagcaaaagaacagataccctaaatctcaaagagctttttctttcgtgtttttcttctgagtagggcatgaggtttcagattccccagtgttgacatctattattttctaccttgagattttacctatagacacagaaagaggagataaaaaggccaggcatggttgctcatccctgtaatctcagcaatttgggacgtcaagaccagaggattgcctgaggctgtaagaccagcctgggcaatatagcaagacattgtctcttcaaagataaagaaacgaacaacaacaacagtaaaaaactgggcatggtagcaggcacctgtagtcctagttactcaggagactgaggcagaagtattgcttgagcccaggaggtcgaggctgcaggcatcactgcaccccagcctgggcaatagagtgagaccttgtctcaaaaagaaaaaggggagataatatcaacatgcaaaaactgaacaatagtaatctcttgtggtgtatacttgccacctctgtaagattgtaatgacaatgactgagttttttcctgccaagttcagttccattttttttttaagtaaaatatcagactatgtgaatttatagacttatttctcagagtatattaaaaatagtggaagttgggagatttttaattcttcatgagtccaagctgagacatagctacaactgacaggatctgttcaccatacatacttccaagtttggaaactatcagcaggcacctgcaactaaacccacaagcgtaaatgttccagagtgttagaatcttattcgcataatacctagcaagatcccagatgtaaacgggagaactcaaatgttcctttggattccgtgatggctgagaagcatccaggcctgctaactcactgaagaagaatccagcagaaggggactggacagaacctacttttgcataaccactgatcccacctaaagcagccagtgctgcatagacaaagccaagccagtataaaggcacctgtgggccagggtccatctgcattgttctcttctaattctctccagacaggagactgcagcaggcctgcacctataccactttcctgaaggtctgggtaaattgatgaggggacacaaactgtacgatgcttattttttaaaatgaaaagatgtttaacaaagcattttattcatatatgaaaacattcaagtttattccctctagacttcaaagtataactaaatgaaatgttttgaagtgcattaaaatgggtaattctttcatatataaaaacagaaaagtgaaattttcatgcttttattaacacttatagtgagtttataattttttaaaatgtgtggcacagtctcaagctagtggttagcattatttgcaagtttgtctatagagtgcattttgtcttttctatttctagaactcttaaattcccttgggacaagaaatgaaacaaatataagaatgtaaattatgaattctctttcttggaagtttaattttaaaaaatagtttaagtacttttagagtgggaatttagaacacttaattcacaaacagtatgaagtacttaatcactgaaagtattagaagtgagtgttaattctcaaaataaggtctcaatcgcagtcataatttctataagaatttctgccatcactctgttcataagactagtactgctcaattcccattgtttcctctctcccttctgttctgttctgtttttggagagcatgggagctgtccataccggtaggcaatgaggagaatgtttataattgagattgagtaatgtcaaatataagccttttatgatacgattatttcctttgttgtaataaatttctcagcctcattaggcatatccatgtagaaaataaatttaaaaataaagtgtgtacagagcagctaaaagaggtggcaaatatagggatgagcccagatagtgacatttttggtactttaagggactgtttcacttcaaaaacaaaatattcctgtttattatttttaggtggaaataaaagctcactgaatcagaattattcaaaattaaaatggtgtctttagttaatggtagtaatgtatggattaccttttaccttcagtcccattacaatgattattttatttatttttcacaaaaacaccttgaggtgtagttagcattatttcacctatacaagtgaggaaactgataccaagagaaacttggcctcacagctggacacaggattcaaactcaggaagtgtggctccagagtccatccatccttagaggtccttgttagttgtaaatctggcagtgagtgccagttctcaaatcagtcctaacccttttcatagcctggtaccagcaaggggattctgtctgcacctccttccaactcaattttgggttgccattcacttgctggctatttgacctatcctctctcagcaataatcccaccctgtctaaaatatgaataatattgtctccttctcagggtttttatgaagatttaattttacgagacagagtatgccaagcacttagcacaatggctagcatatagaaaatagccaataaattattgatgttattatgtaatgtttccagggtcacacaactagaaaaagattgagtcagaattcaggcccaactctgtcttactgggaaactaaacaaaacacacacacacacacacacacacacacacacactttccacaaacaacaggacctacaaagcaaaactcgtgctctttctggattataacactacctctcaactctaaccataactttttagatgagtaaataaggatgtcatgtatgtgctgaagggataagtagcatagtttagtggcttagggcaaactttcaaattgaggtttccattgtgtgacagcaggcaagttaacccctctgaggttcgttaactacacatattaaactaaaaacagtatcagttgtattgcattatcatggataataaattttaatacaattaaagagctccaataaatgttggcttttagtaattgatatagatataaatgtttctttaaaaatatattcacaaaattgggatgcatagttagtgaaatcataaacatgtaaagtcttagagatggatataatcttagtagatgatcttccatttttgaacagtctgtatgctttctctgtcaaatccatttaacctctctgaaaggtcagtggagaaaggggaagaaggcatcagagatcaggactgacccaaatatggggtggttgtacctccagagatgtgggcaaattttctcagtcttggcttgatgtcagtgactagcattggaaaaccagatggtggaaataacccctgttaagcagatgatgggattatcaatcttgtgttctttctcttttgaagcagaacccaaaccaacggttgggactccagtcctgaagagagagagagttacctggactgagttgaatgccagagtttaaccttgaatgctagtcacagcagggacttcttgaattcttggagctcaagtgtctggcctgccttactagattctgaacaccttgaggttgaggatgtgtatcataatatttatttgcaactttagaacagtgtctgggaaatagtgggcacccaatgcatgtttgataattaaataagagcataagatccagaaacggtacagaagatcttgtttaaggatcccaagccatcaaaggggttagaaatcgaggctgcagtgcagaaagcataggatgtcctggggatgggggtgggtgccatggagctgagggtgcataacatttgtaatgacgggtttaggaactcagtaaactgaaactgtcagtgtagcctattcaataaatgtaggaataaagtattccaaattgtttaaaaaatgttgtaagcagatgacatatttaaagaattgaaagccattggaatccatttatattagtttttcatacagtgaaaaataatatttctggcactagaaactcaatttggtaccagagacttgaggaaaaatgtatttataaatgtgtcattgatatattcccttataaataagttattaaatagggttttatgtttataatattataaaattgtaatttgtatgtatgaacgttaagaacttacatggatgatgggggaagtaagagtggaagtgtaaaagatgacattttttggggggtgactggtataactttgaggtttgttttttaactataattttactacttgtttgatatatgtttcccagaaatatggtgaaaacatctttcagtcagaatctaagttaaaaaacataaaacatagtaaaaagaacaaagagaattaactatgtttggtctattgagacaacaaaagaaaacacaaagcacaaactcatactttttttcggactataacactacctctcagccctaactgtgccttctctgataaatcaggatgccgtgtgtactaatgggagatgtagcaaagtttagtggttgccacaaaggtgattttaggtagtcctaacaggtattgcagtgatttggcgtggtatatcaaaagccagagacactggtaccttgtattaaaaccctggatattgtgtgctggcacctgaaggaaggttgtttagaaaacttaaactgagagtaaaactcaaaccaagtgtttccgtgaacatttgtgtcttcttaatttgaaaaaggccatgtattaaaccagtgctcctgtcagtgtggaactttctggtttctcaagaagagtctcttaaattaagcactaagttaatattacacatttaaacattttcgctttcgaaaacatacattgttgtgaaagtaaaatattaaatgtagagagaaattatcacttacacgtgtaccttattttgtagactatagagtccatttgtgctattattattttcagatgtgcctgtaaagtggcttcttttgctgttcttttcttcctgctctctctgtatacacaaatgtccatacagatggaaaggcacacaaagacacacagacacccatgcttttgcttttactgtaaaagagtcatactagagtagaaattacgtgacattaattctctgtaattctctatttctttcctttcatggctatgtatgcctgaattgtatgtaggtctagcataccatttgggcatgaaaacgttgttttacttcacttaccctgggagacttttttttttcctaaattcctaatgcctgtttttaatttattttggcaattcactgtgggagttttaattaggtagtatgtttgggttactattgaagcagtatgtattaactaccaaaagttaaactcatcgtaaaaccctttacacatgaaataacttagataccttgagtaccagcttttcttttccctgcccttatcctggatgtgtccttggcagtttaatctgctttattttactcctttaaaagcgtaagatggaatggctcaaataaaatcagtgggatctctccctgaggagaattttgtcatcagaaataaaagtgacaacaccaagaggggaagtgttataaataaagtgagtagtgtttggtaatcatcaccattcttgatttcctatgtggaaataggactttgatatatgcattttttaaagcatcttgcaatttaaaaaattacacatggaacaagccaaataaatatttttaaaatactgtttttatttagagagagagacagctgtataaactgctctgtgtatgtgtaaaacattgataatacattagacataatttgcagaaactactaattttcacatcatttccaagtagaactgcaaaggtacagtactggtttagctttatggttaaaagcattggctctagagccagataacacaggctcaaaccctagttctgccgtttactggttgtgttaccttgggtaggttacttgacctttttgagcttcagatttctaatctttatttaatgagttttaataatagaataataggattgctttgaggatcaaataagttaataaaccacttagaacagtgttcaataggctggatttttgtttgtttgtttgtttgttgctattctttttgtgttatgttttgtatccagcagaagtggttatttagcttcctattttatgaggtaggactgatgggaattgacagtcttaggaaaaagtacaactgtaagtcagtggaagtttttcctagtcaagatgtcaaatgccagaggtcggattcatgtggcaggatggggtccaaactgtacaaaagcttggagatgaatgaggtgagacagctaagcttaagacaaaaaacaatgtgaagttatgtccttgggcagtgtttgcagtagtatagtgccgctttggaaaacttagaagatgatcctcaactgtgtccactcaaaatagattgtgcatctcaatgtcatagagtcagaaatttctaccactatctgtttaaatcatcgtttatttatattccttaaatattcatacctttcacataagtgagatacattatttttaaaaacgcagttttccttcttgattttttcatattgtcccattattctgagaagagtttattttatgagaattaagttattatcttacagaataaatctgattactgactagatacaagataaccacatatttttcctagaataatttaattccaattttacttatttgtaccttatatgacttattttcaggttagaaaaatgtggtcctacagttttgttttgaagtttgcctgggccatgtgaagccaccattatcatttacgtcaaaaatgaaggttatctgttgcccaagagaaaaatacagcattctcaatttaaaacactaaaatagtgagggtttcataagctgtttcagtgatttctgaccttgggttggaaagctctcatgtctcagttacctcagtgggtatagtgacattgtcccagtctgcattaccaaattgtttcaaatcactttaattaaaaaaaaaaaaaaaaaccagtcatggtgactcacgcttgtaattccagcactttgggaggctgcagtgggaggatcgcttgagtccagaaggtggagacaagcctgggcaacatagtaagaccctgtctctacaaaaatttttttaaaaataagaataaattatctatattgtaatttcaaagtttaggattgagagattgagctcatgctttttagtgtaattataattttggagctatgctgacatatttgtaaacaaacgcttagtgaaaactcatataacaatagaacagccaactatactgtattaagattgctacatgagaagagttccctttaaaaaggaaatttcaactcagaggaaagtttgatttgtgttcattagagaaccaaaaatatttaaaaatattttccatgagttgaaaagtaacatgaaaaaaatggattattttaaaagcattaattgacactttaaaaaaatatatttttatagaacctcaaattgagttaaaattatacttttagtcacttttaggttatagttttcatatcaaatgtattttaaatttaggttttatgtcttttaagtcttcaaataggccattttctgcctattgctcaaatatgtcgacctttatagcatcaggtcagtttacactgaaagctttcaatgtgtttggcatttttaatggaagtcaggagctttacaacaaagaacacagaaaatcatgtaagaagacagtgtgaaaaagcactggacttggagtcagttatttggcttcctatgacaggtccccatttgatcaccatgttactctgtgcgtgtcatgttttctcggaagcatacctgccgccatcttgactccttggttgaacaaatctaataaagataatgcacagcacagtactttttgtaaactgatactcatctctgtgaaataattcatttatctgaaaagcaatataaatgcatgtttaaaaatatactgtgaaagtcaatatttttatgaattctgctcatgaatcccacaactgtatgttgttctcatgaacagtaaaattgaaaatgtaattattgtttttataaggataattggtagtataaattttaatctatttagaataacaggtgggtgaaaagaatacagacttttcctccaggatgagtcatagattttaaaaattaagatgatatttaccatttagtctacagttttgagaatgatagttctattgcttgaaagagttagataccttccaaaagagaaaaggaatgtaatgggaggagagataggcaacagaaaacaagcatctgtcccttatggagaaaaatgtatttttaacagatactagagaatatagaagttgctatatcaacaaaaaatttttatttgctcaaacaggtggataagccaatgtgtatttactgaataaatgagtatgtgctagtggaaatcaatgagtgagtgaataagtgaacaagtaaatggataaactcagtaggtaacacattattcttcctgtttattatttttaggaaacaatacttatttgaaagtattacaaagaattcacttaaagaaccctggtgaaattcctcattttctcttgtggtaataggcagttgttatagtacagtcataatcttttggttgtaatttattatgtaggttgaattactctacatttacagagcttttgggaatcaggagatgagaaaacacaaataataagcaaaagggcagttagtactatcctaaaaataaacattggcccatgtaatcacatcctaaataaaataaactgaagtgggttaagaaaattatagcggtttagaagaatttagtgtgttttctagccccattttcatttgattttgatagtaatgattattaaaggaagacagagtactttgtacttttaacatttagccggcagcagcaattgcagcaatatccaaagtgtattgaatgtctttggtgtagaaaaaggcactggacttgatatgatcatagaaggtttttaagtgcttgagaaaaaggttggggaagcaggtgaaatatgagattagggcttgttggaagtcttaggacattacagagagcataataagtcttactgcctcctgggaacagaatgcatggttacaaaaataaactgaggtggaatttgaagagaagggaagaactttggctgacagggaagcaagatcaggttagcaaaaattctggctatcaagacctctcctggggcccattccctaagaatgtatcccttgtgctaaatagagtatgtatgtacaggcacactgtacatgtttgaaatacttgaataacagttcttcagggattactgtgtaattatttgtatctattgcctttatcttagtgctgatttatggggctagattttgacttaagttacctacaatgtcttgtttcatagtttgagaaagtacataaacaatattgaaaaaactaaacatcagtggtgttatttagtgaatagaacagttggaaacatatcttatttttaaaagaatagctgaatgtgacatatccatggcatgttaaaaaatgaaaaaaaatggaaactgactttgaacagattattgaaatgctagtgtataatttttctgagttgcactataaaaaatttttactcttgcaactagaggaaatcactcaactggaagtgctggatataatttctgacttatccattagtcatcctaataataagaaagtatttagttcctttttttcatagcggtccatcttaaacaataaaattacatagcccactcaaagatatttcaggaaaattgaggtgttgctttcaaaaaagtattaaaaagtgggcacagtaaattgtctgtgtgtgtgtgtgtatgtgtgtattttaatgctactgtttttatcattcatttctcatcatgtagataggaaggttagcagaaaattaccttgagatttatagttgggatgactaggcctggagcattgccctttgctaagataagaaatataggtgttaaaattgatgttttctctttctttttagggagaacatgtaattggtttgggagggttgaatttaaggaaaaacatctgaaaccctcttacacagactgatagtgctgtgataggaagaaaatacccagagagaatgtacagtaagaagaaggaatctaaagacaaaccttggcgcatctctctataaccagcagtcagaaaggagggaaatcaaaagaaagtgtcagagaatgagtaggttaatacatagcaggtaaatgaggatggtgctttgccaaggcaaaagagaaaaacattcagaaagtaactagttattctatagagaagacaagaaatgagaaaaaaatcactttggctgttaaaaggacagtagtaatctttgaaagcagatgagtagaattgggagagaggaggtagaattcagattgtaaaccagattccaagaagatgagtcactagtaaattgggaggtaatgcatgaggcctcaacacatgtagacaactctataaagaaattcaataataataagagaagtgggagtcagctgaaggattcagcacagaagaggttgttgtagagcagtgagggttattccactgcagaatagtggaagcatgtctttttcactaagggaaggggcagccgtcagtggagagtgaaagaatgaatgacaaatcgctaaaatagggaaatatcagagaagatgagaagggattaagaaaaagtgagttagagagattggccttgaatggaagattaaccaaaaacttcctgagagacagaaatgaaggtgcttagccagattccattccctaatactacctgcattttggtcatccttgtcatttgggtggttccatgccttgggtccacactcctttctttactctttttaaaaatattttattttaactttgacttatagacccatctcgatagaatttcatgagggcagaggacatgttttatccatgcatgtgttctaatgtgtttcggtaacccccgaagtcagtgctcttaggggaagaagtttcatagccctgcctatcgatcatagtacaaggctgatgactaattagctacctaggtgaacctcaaaagctgtttccaaaacaagtcctcaatttctaatgaatggggcagattattatgtatcagacttttttttttcctgtttttggttaataaagttactgcataacaaaacataacttagagttcagaagtggatatatccaaagccagatagaagttgtaactataattcattgtaataagtagaaacatttaactgaaaaaaatgaaaagacaaaaatttgcaaggcaaatagttgttaaatgccatggtttataccactatgtcaaacaaatgagatttcattatgtcattatattttgtctgatccataccataagcacaaatcccttgattagaatagttggattgcattttctgattcttacatagcaaaaataactctaagcaaaagttaactaaatgttgtctgcctctcatgtagaaaacatgttttatgttagtgtttgttttatggttgctattttttctgtaagttattagttttcgagttttattaaaggtgtaatttcacagttggagtatatttgtcaaatcctgaccctttttacttgtacatatatggtacaacaattttttaaacacctttttatgtgtaaacacttataggaggggttttaaggtagtgggcttgaagtcagactgctagtgtgttgaattctggcctcaggaatcactagctatgcaatcagatacaagttactataagctgtagttgtgtcatctgtaacactgggttacttaaaattctttgctgaagtgacttttaagatatttaaatgaagtgaaacacaaaaagcatgcaaacagggtctagcacatgataaagccttattaaatgttagctactattattatattttcagattatattttggagattcaaaagtacttagtaaatgtccagcattgctctaagcatatacttggtctctactaatccactttatttatttttttcacaaatgatcgataatctatttttcaaagtacagttagacatagaaacattatgaactgtctaccatttttatggctttagactcaacattatatttgaagtgaaaaattgtagctattttaattcctaaattatgtaaagctataaaatgtgttatgttagccagttgattttattcctcctgaaaatactttgttttatttctcttcagaaggaaaaatagaaagataagacagtaaatttaggatgagcaaaatatggccgatgacagctttcatgtattcattttttcatgttttaaaaattattactatcactaatcacttaaaacactggttgattatgactgttgtacagttgcacagacatcttgttttcttctagagagtcccaggaaagcatgagaacatcatttaactacactagaattgtaaattaaaacaattttatcctggctcacgtctctagggctgccttgaaccactctttagtgtagactctcctgtccaacctccctggagtttttaaaacacatcgccctgtctcacatttctgtcttcacacaattttcttttcataaaaattttcccaccctggtttttttttgctgttgttgtttttttttggttgttgttgtttttaaacttacgactcatccttttagactcaataccggagacagctcctctggggagtctcccttgatcccctccatttcctaagctgtgggaaatgtctccgttagtaacccacatcagttcctgttgcagtcatttactgacctgagtcctctgggatgcagcagagacacatcatttgccctgcatgtactgtggctaacactgttgtgtcagtgctcacttagtgttggttgaatgactgcatgcaagaatagctgttttaatttggacattaggctaagttttatcctttttagggaggtgcatggatgtaaacttcttggattatgtagtacgttatgaaatgaacttgtttaagtctattttatgatgaatagtttacaaacatagaaacaacacttgtagtaaactctcttaaaattaaatccagacagatttaaactatgtgtgtcagatataattttttgtcttttatatgagagtacaaaagtcagagtactctgtgatcagcgaacaaaaacacacctcagtctcagaagcttatcctagcaaaggtgtctttctttctcctgtaaagtcaatggtgtactctttcatccaactactcaggaatccaagcttactctgccttcctctgatgtgtggcttccaaagtgtctgaggctgtgtcagagagagatgggaaaagaacattggtttccaataatctcttctgggaaatcaaaccaccatttacgcttagtgtcttttggctagaataatgtgccaccaacttaatgcaacagaggctgaaaaggttgccttttagagtagtcaggcagaggaaatagtgcgtaggaattgaccaagccactaggtgatttgtctccttttttgtgtttctatttttgatttatttaatttttttgtgatacttgagggcctggatgaatgatgtgaggtagataccactgggtaaattcaagtataaaacataaattctatactaattatcaagcccttgtcatatcttaggcatattaattattgaagaagagtctatctcaacaaatccttttttttttttttttttggcttatagtccattttgaaaatgtggtagacattttaaaacatagtgcacatcagcatgtaacctcaaaatctggcatgcaaattcagaggttcacaaaatctctgcagcccacccactgtagccttcccagagttaagagcacctggcctgtgctacatggattggtgaaatattagaaaagatgagagaaaatcagtatgagcataaattttatcttctttttggtgagtactttgaaagaaaattaggacctaatcccctagtttaagtgaaagaggtaatttggttgctacatgatagagattcattgaaggagaaagaagtagacagtagacaaagttgttgttcaaagtataatcaagagtcaggcatccaattgaggtctgaacaatagcttttattcatgttctctcaccagtctgtgttacatgaagctttaatgatatttgatgattgaattcattttttaaaatagctgcattgcagaaaagtggtttgctattaaaatattacgtaccttaggagactgaggtggaaggattacttgagcccaggagtttaagacaagcctgggcaacatagcaagaccctgtctctaaaaataataataataataactgagcatggtggcttccgcctgtggtccctgctacgtgggaggctgaggcagaaggatcacttgatgccatgaggtggaggctgccgtgaggcgtggtggtgccatggccctccagcctgggtaacaaagcaaaacctgcctcttaaaaaagaaaaaattacgtacttgagtttggatcatacagattaatgaaagaactacaaaagatttttactgcttaattctgtatttggggtctcttcatttttaaaaataataaagcaatttgcttt

SEQ ID NO: 1545 - DNA, 5940 bp, Homo sapiens
cttgccggcttccttgcaaagcccggtgcaagggcctctttcaaaatgaacccactggtgtgcctagcagtcggtagaagaagcgggagggcgtccggtctgcacgcccgccgcgaggttacaatgctgaacgcatgagatggaagataccaacgggaggccgaggggatccacggcgcccgcgcgggctccggcttcctcctgctctcggcgccgctgggcgaccgcccatgacccgctcttgcgggctctgtccggttgacaggcgaccctgtggcccggggaagcgcgggagggcgccggcggaaagttgaagagcgtttttctcgccgccgcgtgcattaggagctcgacgagtccgccctgggcttcctggtggggctgggcgggcgggggaggggccgcgcagcagcagcggaagccagacctcggcgataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagcttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtagaattttcatcactaaacaatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagt

SEQ ID NO: 1546 - DNA, 1113 bp, Homo sapiens
atggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttgattcattgaaaggccgttgctccagggagaactgcaaatatcttcatccacccccacatttaaaaacgcagttggagataaatggacgcaataacttgattcagcagaagaacatggccatgttggcccagcaaatgcaactagccaatgccatgatgcctggtgccccattacaacccgtgccaatgttttcagttgcaccaagcttagccaccaatgcatcagcagccgcctttaatccctatctgggacctgtttctccaagcctggtcccggcagagatcttgccgactgcaccaatgttggttacagggaatccgggtgtccctgtacctgcagctgctgcagctgctgcacagaaattaatgcgaacagacagacttgaggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccagttcccatggtgcacggtgctacgccagccactgtgtccgcagcaacaacatctgccacaagtgttcccttcgctgcaacagccacagccaaccagatacccataatatctgccgaacatctgactagccacaagtatgttacccagatgtag

SEQ ID NO: 1547 - DNA, 90100 bp, Mus musculus
  misc_feature (1696)..(5225): "n" at positions 1696 thru 5225  can be any base
  misc_feature (10303)..(10322): "n" at positions 10303 thru 10322  can be any base
  misc_feature (32410)..(32429): "n" at positions 32410 thru 32429  can be any base
  misc_feature (34679)..(35400): "n" at positions 34679 thru 35400  can be any base
  misc_feature (38214)..(43788): "n" at positions 38214 thru 43788  can be any base
  misc_feature (45408)..(46631): "n" at positions 45408 thru 46631  can be any base
  misc_feature (47453)..(47810): "n" at positions 47453 thru 47810  can be any base
  misc_feature (49495)..(49572): "n" at positions 49495 thru 49572  can be any base
  misc_feature (52976)..(53745): "n" at positions 42976 thru 53745  can be any base
  misc_feature (59340)..(60268): "n" at positions 49340 thru 60268  can be any base
  misc_feature (76210)..(76409): "n" at positions 76210 thru 76409  can be any base
  misc_feature (83590)..(83609): "n" at positions 83590 thru 83609  can be any base
  misc_feature (88024)..(88383): "n" at positions 88024 thru 88383  can be any base
gggtcctttgacaaccccaaaaggtcatgacccacaggttgaaagccacagcaagctgacctcccagccagattgaacttgacctcatcaatctttattgtgttcatggaggtcagaggacagcttgtgcagttgtcagggaatgaccaggctctgaccttttccttcagacaagcagggaagtctcagccctaatccttgttcctctgtgcaaactcaagcttgcaggttggaagggcaacaggagaaagagttccttctcctgacttaaactcctagcaatcaaataaataaatatattgatagataaaagctaggcagtggtgatacatgttttttgtttgttgaggcagggtttctctgtgtagccctggctgtcctggaactcattctgtagaccaggctggccgcaaactcacagagatccacctgtctctgatgggattaaagacttgtaccgccaggcagaggtggcacaggcctttaatcccagagtttgggaggcatgggaggctctatagaaccagttctaagacagcaaaggctacacaaagaaaacctgtctctaaaaaacaaaagcaaaacaaaagaatctaagggcctgggacaacacaggtttcactcttctgacctctggaaacatacagacctggtttaaaatgctggctctgtcacctagttgccgacttgctgggtggtcttgggaaggtcagttacccggtatagtgttctgtaggcctccccttaatggaattacggtaggataatactttaagccctaagaaggagatgagatgctggtgacagtgtcagtgacaacacaatgacctctgcattgtgggtggcaaagacaagtcaataaaggtgtagggggtatcttctctcttgatgagaatagcacaggtgcatctgggaaatggctgctcttctcacaagctctctgaagtgccacagtggcatgggagaaacaataatatcgctgctctggccaaaggatccggtcctggccttctagcttgggtgggcaggaggcaggagcagattggcttctggaacaggtagcacccctgggatctctagctggagtcagctaatacatccacactgctgggatcttgtcccaagcaaggtcttctgctgcttctggccttgggaagcccttggaggtcattcagttgctttgtgttgcttctgatatcattacctcaacgttatgaatccttcttgtacaacatgttcaagatctatctatctatctatctatctatctatctatctatctatctatctatctatctatctatctatctatcggtatatctcatatccattttccattttctttctagaaagagccatacctgactgtaatgccatgtgcctgggttttcaatatagaccatatgggaataagactccaggctgattgattcacattcgttagtaagtgcggtctaggaaaaggcaacctaagtacagaggaagaacacgctctgggcagaggggactgtagggatccaagcaggaagtcttcgtacctgagtactattactgtcaggagtcgggtgaaaggaaaggaaggcatttaaggcagcaagcaaccacatggagttattcctgggcacaaccacaagtcattcaattttggaagcagagagaagggatttatcaaatgtatgacttaaaagtatcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacagaacgctgagtggaaggtgaggaagagctgggagagttggagcagcagtcatatatggtaagctgcagtggttacagtaagcacaaaggcctgaagcaagagctggcttaacagtacacagaaggtaggcatggcaaagggggaaggatgctaggtactcgggccaagcatgcaggacctttgggccatgataaggatttgggacgtttagttttagtaatggggaagtatctagactttctgataaggtattgggcacctttactggggaggaccccaggaaaaaggctgtttgctgagacaaaagtcaggaatcaagacctctctgaggttgctgagtatccagttttgttagacaacagttcaagcaatttccattgctgtgtcatttaactacctagactgtagtttattcccccagggatgttactacctccagagaacatattccaattatcttggaaaacaaggtaattagaattatgataagtattcaccatctcagttctcacaatgaaaaaccacaaggacaaaagtaactccagatagctcagccctccttggcactggggtgggggctgacagcggatggagccactaagttatctgaaactactgttagtgtccagtcgctttcctttcaaggtacaaccctactggaaaggagggatttagtccacagctatttaatgagtacctactatgtgtaggcattcttctatagggatagagcagaaaacaagatttgatatgagggcagattcctgtccttcccagagcagacaggtatgcaagataaatatgtgaaacaccctagaaaaaagtaaagctggcagtggatatttgggattggagggactatggtagttttaaataggctacttagggtcggggccacaagctcattggaggaggagcactgcttagcatctgttggaccttgagtgagtccccctagcccctttcagattcattggacatctaatggaaatgaatggaaaggcctggtatgagacaagcctcgtgcgggggtgggagtaggagcttctgtgaatagtgggtgtgtgtgcagagtggaaagaggaggagctacgtgtcgacaggtaagggcaggggctagcacacatcctggagtcctctgcaattcgagctctacaagatgcaaatgtgcactttataattttttcccacatcccagagcaaaggaaaaaaaatggtgctcatgtggtcacttctttttttcagtgtactgaactagactctggggggtggggggtggggtctcgtcttccctaggcagcacacagaagggaagcctgtagcatcaaaggatacaaactgggctgagacccaggattcttgtttgttacttaactatgaccttggggggaaacccctagatatctgagctaggagaagagcattagatgaaggaaatgcttagtctttttgatcaggtgagcaccacatgtcatctgggtgaggactgcagaggagaaaagagctgtttctgagtcaaacgttatcagagtatggctgcacacacctataattaaagaatttgggagtggagacagaaggggcaagagtccaaggctgtattgagccctgtgtggttctgtctcaaaaccaaccaacccactgaccaactaaccaaagaaatggagaaatatgtcaggactcaagcaacacaatgaaaagcttctggcctgtatggcgtccattatcccattcttgtgtggcactcaggatcagggcaggggagcatttgctttccatggactgaggaggcaagagggtaaggttgtggtacagtcttctgggtcacaagagcctgaactctcctcaagataagccctagagttggcataatctgtcaatcatgatacaaggccccagaaggtagagagctccagcacagcgctgctaggtagtcacgtggctaactcaccatttcacttcataaatcatgtacttcttttcccactgcctcaccatgaggctggctacgatcctccttcttcagcttcctgactgcaggtgctacagtccgtgtatctatacctggtttcatgtataacttctgctacatttaagagtatccatacatgcagccgggcgtggtggcgcacacctgtaatctcagcacttgggaggcagaggtaggcagatttttgagttcgaggccagcctggtttacagagtgagtaccaggacagccagggctacacagagaaaccctgtttccaaaacccaaaaaaaaaaaaaaaaaaaaaaaaaaaaaaaaaaaaaaaaaagaaaagaaaaaaaaaagaatatccatacctatcaataaagttgagattattcctttgttagttgcagtgccagccttcctatataccctttcctgcataatgaggaggacagtctagggcacaaatgaatcccctaaaagccctagctgcatacttgatgcatattaggttcttgactcttgtgcttgtttatgacaggcaagtactctatcaccaagttataggccaagcccagttttcccttccatatctgaatccagactggcttgggatgcttaaagctcctaccttaaactcagaaggactgggattgctcttccctttctcacccatcctcggtggattacatgttgtggatctactatataaaccagtgcttgtcaaactctgatgtgtgaacccattgcctgggggactcccactaatctgcagatgtctggggttggggcgaggctgggaattatcccttcccagcaaggtcaagggttatgcttagatactgacatcgggtcattctttcagtagtaggaatttagacacaactaagttctatcacttaagataaggaccctataaagggtgccaaagactgtttctttaattaacctttccacttttgcttcactcagcttcaaaacccactaagtgcagaatactagcagggctaggccagaggatatttctcttggttttggaacctcctccaggaagatcttgcaactacccctctctacctcttttggctttttgatcttaccttttccctctgatgataattaccctctaattagcacccaccaccatgtcatctaaataattaacctaagtgcagactgcacctctgcctgccatcttcaaacaaatgataaaacaatatcctaagctgctgattaaaaagacaaaattggcccaaataggtcatatatgtataccatatatagtgcaagactggttccttagcataagttaagaggcgatggcctgctgtgaagtcagtcaggctgatactggggaaactgcaaatgcaagaatgtaagttatgaacttaggatcaaaaggaaaacaattcaagtgttgaaaatccaccttaaattcctattgggaagtgctcatgttttttatttttaagagggtggcagaagggagtgccaagggcatctaaccaagggcatgctggagaaaaactctactattaacttatcctctcagtcagaagtttttatttttcctttttagctttgttggaaaaatccattgactacagtggagggagcttgaaatttgaggagtctttaaaagcaaatctggcagaagaggttgtcttttcactaaaagcaattagtagttttctaatttctcagatgagtctccattagctgcaaggccaatgactgaccactcacttctcctaagggaaactgttttagaaagctattttctcattgaaggtttaaaataaaacctctccaagtttctcaaccaggtgattcactgacatgaaaaaaagtctctgcagaagaaaacttaaaaatactccgtccatcattcactaccttcttgtccgggactagttagttgaaaacccaaaccaaaacaaacaatccgtcccccccaaaccaaaactttattatgaacaatttgagacataaatactggtatgatagcatatgtgtacatatcccacagctccaacatcgaaggacatcctcagttaatttattcccttctttcccagtttccagaggcttagtctaaaacaaaataaacgtattggatcattttacctatcaacactttagtgtgtgtgtgtgtgtgtgtgtgtgttttaaatttaaagccacattaccgtaagcacgttcgataaggatgacgataattccttagtaacataaaatactcggggagcgggggtggggtgggggtgtggggtgtcattgctaacaggtaggggacagaactccgtagtggggactgaacaagaaaggagagagaggatgaagtggccggctgaagcggatcccggctgcgaggagaccagcacccgactgctccaggtttcgctgctcgtttacctgcgttggctctctcgcaccgtcagaccaggtcaaaggcggccccaagttccccgcctccaaggtccgggcggtggcccagcaggctcggcgcagctgcacaagtctctgtccctagacaccggagggtccctggaggggaaacgattgacacagctgcctgcactgtgccgcgagccttcccgcgctgcacctgcgtctcgtcgcgtggctaggaactgggactggctccggagtcggtgaagtccagcaggcccttagccagaacctataccgttcgccagctccggaaccgggctttagacaccaggaccttgcggaagagagaactacaactcccgtcgggccacgcggtccgaccaatggtggtagccggcgcgtgcggggcgcggcgcctgcgcggcggtttgagtaagaggccgtacgattggctgcggagtcgggcggccgcgcggggcctgtgggaagcggagtgacggagcgagcggctgttggaggaaggaggtggggggccgggagcgcaaatggcgttgagatggttcagggccctgttcaaactccagcgctgaccattcaccggcggaggcggcggcgcagaaggcggcggcggcccagcgggggcacgtagcgggctcggcaccggcggcggccgccagggaggcctaggccctgtccggccggcgcgcctgaggtggggagggaannnnnnnnnnnnnnnnnnnntgtcgcccgagcttcctatttaccgaagcggagccgcggactgtgacggcagcagagcccctcgcctctctcggtggcaccggtcggcactggtctctcgcgcggggctcccgcgcccgcccgcgggccgttgggagcgggagaggcggaggcggcccgaggccaaagcacccgccaggcgccgagggtaagtgaggtctcgggcggctgcctaggcccggagtgagttggggcgggtggaggcggcaggggcggcgcgaggctcgttgctcacctggcttctaaggaagttgggcaccggaggatcgcaagaaactctttcccttcccacctcttaattttgccttttgaattcttctccggctacttgatttgacttctctcttccaaacccggtccggttgatttgagtcccgaattctttttccccgtcgtctcctccgcctctagccgtcaccgagaggccttgcttcggggactcggtagcagaagcttccggggcgtccgaagcgacatccctttcctaggctgtgggggttgggaggagaaaagttgcgtgagtgtccagcccgaggggtgtctcggctccagcctccgggcgcactcgcagcctcaggtgagggtttctgtttgcccattccactctcctctctttattgaagcccccctaatgcattaccttgggtgtctttcctggaagtggctaggtttctttacagcttcagtgtaaggaggttggttggttgttttgtataccctttccctaatttaaatcgcagtgcacttccatcaaaagtcagctgggctttgggatgaagcgaaggcctcccaaatcgaaaacaatcagttgtgaaccttcttttcctttttagttaggactgttggtgaaatttgaagccagaacaagatagtgtgtctgaaatgtgcgtaaaacgtcatgccaaatatatatgctgaatttgtacatatgttaagcttagataatgccatcgcagtagtctgctgactttttaaaatggacgttatggaaaacagtaaaagcaatcacgtaactcttgtactcatatctcctggattctgtacataataactcaaccatattttctaatcagtacgctccccattccttaatattaaaaaaatcactgatatttcatcaatatttaatgatgttaatacatcagcgaatatttctgagacgtgatcttttaaaaatacagttgtcttattacttagctcagtatcatatattcatttgcagatcttaatcttgcacagtgaatgctttactgttttttacggtgagtttttcagatgtcataaagaagatcaagtctagattttttttttttttttggctttagtcagcatttttagatgattgccatgtatgtgtgcccaaaacattccaactttgttggaatgtatatatgtgtgtaggtctgcgtgtctgtagtcagcttaaagaaatgacttttcttgcctttggcagctgcccaattacacttggttttgtttaataggctatacttaacaagaaagacaatgaagcttgttagtgttcagaactacaaaatggaaactctctgaggaaagctaaaatttcttttagcacagatgtgtacgatgactaaattattattttatctgatcagagttgttttcctttcaaacattagggtggtggtgagttgtcttctgaatatttgctgaactaaattggatagtgattcgttaagttataagaacttaatagaaatactaaaagtgtagctcaaaaatatttgaaaatataagttaaatattattcttattgtaagtttccaagtaatgaagattttccaagcccttaagtaattgcttaccttccccctagaattgataaattgatatttaaactgcagaaggccaaagtgttaagaaatggataatgattgattgtgctataaaagcactataccttatattttttaaagtgtttgatttttttttttgacttttcttgtaaaattttttcagtatatttttgggtaaatcaggtaaatgagtttgtaaattgaagaggaaaatcaaggctatatatttctattttataataataaatcatgtacctttgtaaaatggagttctccaacttcagaaagatgttactcagcaatgagatacaggaagtagaagaatggtttcttgagtttagggagatgaccattgaaggagctttttaaagtcagttaaaatcactttagtctaagaatcagaatctttaagcttgggtagaagctacagattgtactctatgagaaaataagtttttctaaccctttatgaggagctgtaaaaatgtcaaagaactaagtttggccaactgacattgtttagatcctggaaaacttaatatattgtgactaaagattttgtttttgggtgtttacactattctgattaagttgtgtatgaagatatggaatttgcatgttttaagttagatttgtaggtattgcattgtgagttggttagtagtaagctttttttttttaaacattgtaagtttcatatgaatatgtccttattgtaaaaacaagccaaaacaccaccaaacctgatgtatggaagtaaaggatggaaaacgaacctcttcagctcacttattcagactagtttcaaagtttgtgtgctgaatgttgaaaactatataaggaagtcctagggtcttatttttatagagtgcttaaaacttgttaaaaatttgctgattatattttcttaaatttcttttcacagggaatatgaaacaggtgtcaaaatgacatccagatttggaaaaacttacagtaggaaaggaggaaatggcagttcaaaatttgatgaagttttttccaacaaacggactactcttagtacaaaatggggtgagaccacatttatggctaaattagggcagaagaggcccaatttcaaaccagatattcaagaaattccgaagaaacctaaagtagaagaagaagatactggagatccctttggttttgatagtgatgatgagtctctacctgtttcttcaaaaaatttagcccagggtaagggttcatcttactcagaatctagtgaggctgctcagctggaagaagtcacttctgtatttgaagctaatagcaaatgtagtcatgtggtgggtgaagacagttttgcttccgacagatgcttacttgtggaggatactttaattgggaaagagaagagcataagtagaattccagaagacaacgcaaacaaaagtagttgcactaagttgctaacttcaggtaagttttgatgttcctataagccaagaaggcctttttaaagctacttttgtgataatgaaattctaatttattacttgtgtgcatggagtgtttggaaaaaaagggcaactttgtatagttgtttctttccatgtttttgtgggttctagagataaatgcaggttgctaggcttgcgttgcaagcaccccaactgagccatctcattagcaccctaaaagagccaagtgcttgatgggcattgtagtgcttgcttttaattccagctcttagggggcagaggcaggtggatctactagagttagacaccatgtgtgtactgggaactgaacctgggtcctttggaagagaagccagtgctcttaactgctatattatttctacagtccccttgtaaaagaacttaaaactttaaagagttggaggccagcctggtctgcaaaatgagtcctggacagctagggctgttaacaatgagaagccgggtcttaaacagccccaccccactcccttcccccaaaaagtgtgtgtgtgattaccacttgttttttttttttcctccctgcatttatgattagtagaggatattgataagtttgtttagtgtgtgtgtgtgtatgtatatatatatgtatatatatatatatatgtatatatgtatgtatatatatgtatgttgcctgcataccagtttgtgtgctgtgcatgcctggtgccttcagaagctaggagctactagagttagacaccatgtgtgtactgggaactgaacccaggtcctttggaagagaagccagtgctcttaactgctgaattatttctacagtcctcttgtaaaagagcttaaaactttaaaagagctcaatcatatttaaattttaattaaaacaacatcttagaaatttagtatattttgggaacagtcttttataccttatatttattggataatgtttttataatactgtaaattggttggctacctagggggaatttgttacagtcttaatgtaagatagatcaaataatataatggagtgtgacttgcatagccttgttaaaaaaaaaaacgctgagcttttttttctacttttctcacctttgggtgagagtgagctagcttttgttgtcattcccttgatcctctgggctagtactcatttggttgttgccttgttcatatttctcctaaagcattgttcttaagttaagcttagattttcataggaaaacaagtcaaaagaagcctaaaattgtttccaaatgagcttctaaaatttatcatataagcccggtctggttgtgcatgcctttaatcccagcactcaggaggcagaggcaggtggatttctgagttcgaggccagcctggtctacaaagtgagttccaggatattcagggctatacagagaaaccctgtctcgaccccctccccccaaaaaaagttatcatacagataaaatttctgagctcaactgaatttttactcaactctcctcactttgtaaagtttgcagagattatgtgactttctaagatcagctagtagcaaaattggaatgaatttttaaaaattacttttaggtttattattttatacgagttctgcgtgcatttatgtatatataccatatgcatgcttgctgaccaccaaggctagaagagggcatctaattcccctggaactggagttatagacagttgggaactacaatgtgggttctgggaactggaccaggtcctctgcaagagcaaccagtgcacttaaccactgaatgagatttattgattgccaagatgttgagcctactatttgaattgtgtagtattttaattgctggttcttactgattccagatagttgttttacataggaggtaggtggcctgtagaagaagagtgtaggtggctagttgttaaattgtcctggaggaccaagggattatggggaataatactgcagaatgagtttgtttattcattttccccttttcattgactttctgaagatggaacctctggcaactcctatagggtaggaagcaaacttgaagtgtctttaattttaatttttgtaatgctgttagcctattctaaatgcgtacaaatcagttatttttataagccatgtataagttcatgtatttataagttggttctgtaatagagaatgcttttgggctttttagattttcttttctttttttttttttttcattttttgagacagggtttctctgtatagccctggctgtcctggaactcactttatagaccaggctggccttgaactcagaaatccacctgcctctgcctcccaagtgctgggattaaaagcgtgcgctaccatgcccggctagattttcttttcgttgccttttcatctaaacttttggttgtttttttttttttttttttggtttttttgagacagggtttctctgtgtagccctggctgtcctggaactcattctgtagaccaggttgccctcgaactcagaaatctgcctccctctgcctccaagtgctgggattaaaggcgttcgccaccactcccagtttgggatttcttgatttttgcatttttgtcatgttgtcagtgtccttaattttactctgaaaactattaaaaattttatcaacaacttgttcaaagtatgtagatgcacttgttcaacgtgtgcaggtttaagttgcattgtaacttttcagtgagatatttgttcaattactggtttctgcagaggaattatttcacaccaatgagaaaagcttatccaagcttaagagttttatcatttttttctaatagtacatattaagtacatgttttcttctgtaaagaattatgtcatttttttaaagatttatttatttatcatatgtaagtacactgttgctgtcttcagacacaccagaagagggcgtcagatctcattatagatggttgtgagccaccatgtggttgctgggatttgaattcaggacctttggaggagcagtcagtgctcttacccgctgagccatctcaccagccccttatgtcatttttttgattccatctctgggaaccacatagtaggagagaatggactcctgcaggttgtctttggacctctgtacattcaatgtgtacaatgacttgtgtgtccccacatgtgtgcttactcacacagaaataaatgagtaagtgtaataataagttttaaaaacatcagcagttgccattttgtaagtagatgcttaatagataaggaaaagagtagaaagtactacaaactatgtctaagaactctagggaaaggttgagttattaaagtactcaaaacaagaccccaaattttccactttctgaaaagtagtgaaagaaccttgggtattcagtagttgatatatggcaggacttgttgtctctccttgtgaatgttgtgggttgttctgatgctacttgtattctgatgttaattctacgtcctcagaagaggttgcccaggagctgtgtgatctctcctgaaccttattcccattttaactggtcaataaaagctagagcctgtgattgggcagtggcagggaaggaggaggactgaagaagagatgaggaagccaagatggaccagaaccacgtggccaggagaaagcacaggtagcaaagggtcttatagctggggaataagttagtatagtgttagatctgcccaatctaggcttatagcttataattgtaataattggattgtggtggtttttttttttttttttttcgagacagggtttctctgtgtcaccctggctttcctggaactcactctgtagaccaggttggcctcgaactcaaaagttggcttgcctctgcctcccaggtgctgggattcggttggttttttaaactagtcaattcttagacaggtgtggcattaaaatgactgaacaggagctagagttcatctttttgaggtatcagtatattatgaatcattttacttgaccttttatattttattatgatttttaaaagacacagtctcactatatagccctagttgttctggtaatcactgcgtagactaggatttggcctctgccttctgaatgttggggttaaaggaagcacatccatgcctggcttaagatttatctttaattatgtttatgtgtctgtctgtctgtgttgttatgtgcacatgagtgcaggtgccagaggcattggatcctttggagcttgagttataggcagttgagctatctgacacagatactgggaactgaactcaagtcctctgggagagtaatagtcacctttccagactcccccccactttttttttttaaacataaatatgtttgtgtgtgcacatgagcattagaatatggaagttagagtacattattttggagtcagttccgtctttcaaccatgtattccagcaaatgtattcactgtcaggcttgtatgacaagcacttcaacaagctaactcgtcttacccactggagtgaggggttgttttgctgagacaggctttgtatatcctagactggacttgtggacactgtgaacaaggatggccttgggcttctgatctccagcccccactttttgtaaatgtgaagattcaaggcgctctccaccatacctgggttttttttggtgttggttattgaaccagagccttttgtatgctagcaggcactatactaccaattcctgctagtattcaagtttggaatccgggactgtgcattaaaacgttatttattatttatactgggtggtgtgcacctttaatctcagcacttgggaggcagaggcaggtggatttttgagttcaaggccaggctggtctgaatgagctccaggacagcccgggctatacaacgaaaccctgtctagaaaaagcctatgtaccctatgtgggcagtgtctgtagagagcagaatagggtgttggatcccctgggactggagttctagtcgattgtgggtgctggggcttctggaagagtaaccagtacctctgaaccatttgcttaccccaaagatacttttaaaaaggttgcttttgctttttatgtggggttacttctgtttctcctctttgttaatctggactcttgaaaaaattatgtagagacttaaatttctgcttggcatactttctatgccagccagctggaattcagtctacatatcctgccaaatattgagataaccatagcataggctcttaatttgcatggttggtttcatagccaataaatttttttcgtttgcttaaagctgtattgagtgtgtgagctttctggggggtattatcaggacattctgagatttgattttagaaccaaaggtgtttttcaggaaaggggaatgaatagttctacttttgacagttttaaagtgggctgaagaggtggctcaggggttaaggatgcatatggctcttggagaagacctgtgtagcttccagcacctaccagtgattacagtcccaggggaaccaaacatctctggcctctgtgagcacctgcactcttgtttatttacccacacagaaggatataatatgaacatatttttttaaagaaacatgagctacaaacttatctgaggtgatagtcttaataatatcaggaagttagttatttgcctataggtagtgagtgtttgtataaaatgtacttgtcatttttcaagttttatgaaaagtagttaagaaatctgtttctagttccagctttgtgctaagccttttatatttcatagccttgtaaagctggcttaattcatattatataaagtgtaaagcatcattcagaagttggataacttgaattaaatggaatagttgtgaaacacccaaattgctcttttcatattatagtctggtattgttatattctggtagggatgaacttaacaggattttagaataaaacagctgtcataagatagatttttaatttaaaatttattttttattttttatttttggtttttcaagacagggtttctgtgtgtagccctgggtgtcctggaactcactttgtagacgaggctggcctcaaattcagaaatttgaggccagcccttgggcctcccaagtgctgggattaatggcatgtgtcatcactgcccagttcataaaatagattttatcttgatgttgaagtgaattacaagttctcattttttttctatttaagtaatttttaaaaaaagacttatttattttatttgtgtgggtagtttgcctggcatatacatgtgcaccgtgtgtttgcctggtgccatggattccctggactacagttaaagacagttgtaagctaccatgtgagtgctgagaattgtgcctgggtcctttagaggaacatccggtgttcctaaccactgagctatttctccagctcctatttttttgggggagggggcaaaataaggccagagtttttaatacttaccgaataaaatggatcttatttatgtagttaataaatacctttttttgtgtgtgctgtatacaaacaacagtatgcaaattttgtggtagatttttacatgcttttgtttgtttttgcagttgctggagattgtattcagggtcctctacatccagccacatccccagttgccctcctttactaagtagattttgatctctgtcttatttctgtctcgaggctagtacaggctgtcctcatattgaagacatacctgaaaatgatcctcctgcctctgcctcccaagtacaaaggattatagcaggtgccatcatccttttatttcttatctctgccatcatttctcccagcccttcaaggaaagccaaggttgttctcaaaggtcagacaggagtgcaggaggccattagcaagttttccctcacatccaagagaatacccgctttgtggtaattaatgaaattgtaaacataactgtcctcctgtatgctttttaggaggtgtaccatggacttgtgctggtcatgaataactacttttagcacaatgagattttttattatagtacttcacaggacaattgtgcccccccccccccatatatatattctagtcccttagacttagagccatgaacaaccacacctggtttttgagagggagatcaaggatggagcttaaataagcagcattgatttgaaataatacatgtgagactacgtataaaaatatttgaacatgaagtcattaaatatttgaattgagctgtgaaaaaagttcctatacctatagggtggagaaaagaaactaaaaaagaaagataatatgaaacagccagagctattgaaggctcaacttagttgaattggatttgttgatataaaagttaaataaatgagggtttcacagaatggttgtagtggcctgaggattgagaaaattcacatatgtaagtgtacatgttttaaacagaggaactgggacagctgggaacagatggcatgctcaaattagataatatgagaagggtttatttacaaaggtataggagggatataggaaaatcatgggagatgaggcctcatccttggttcttcaaagtgaagctattattaccctgactcaaatgaattaggacttgaagaagcctgctttataaggagctgaatctttctgttgaggacctaattatgttgtctcagggacagcagctccctcctgatagaaccctgtgtcagcctaaagataagggctgttttgttgattggaatgataggaagttggtctaattttagccattctgtatagtaggcctgctagtggttgtgctggtaatgtggtggtggtggtggtggtgattataataatgataacaataatgatataataaattttatatgtaattccagctcctaagtgctggattatagataggctgttttgctcagtttttgagaagtattattgaaatgacttttggtttctctacctagagcctgttgttacgcattgtacattgagttacatctctaatcctcatttatttactatattatctttaaaatgacatataatcttgtgtttcactagagtatttcatatgctagttaaaagaagatgctttacctttcaaattttgatgtaaagtcgattgaggaaattgggaggtttttaatttttttgaaacagtctctaaccaaggctgacttcagattcctctatagcagaaaatgaccttgaatttcttatcctcctatccccatccggagcgctaacattaaactcaggtaccactctgcctgtattgattcagtgcttgaacttgaaccaagggcttgatacgtgctaggcaagctatcaactaagttatatccccagctcctagttcacaaataatagttcattctctgtctttttaggtacttatggttgatatatccacatgttctttccacagtgaaaagtgttttccttcagatttcatgaatacttttttttttaattaggtattttcttcatttaccagatttcatatatactttctatttcttttttggaacttgaacctaagaccttgcattctgtcattgaactattcccctaaccttagcttgtatactgtgtatgaccctaaaaacctaaatatgtgctgcctgtagtagcatgattataatgctagcatttaggacagcaaggtgggggcaatctctaattggaaattagtccaggttacatagttcctcggcagtcttggttacgcagtgaggtcttgtttcaaaaaatacacacaatgtgagatataaaatactgcaatgtggggctggtgagatggctcagtgggtaagagcacccgactgctcttccaaaggtctggagttcaaatcccagcaaccacatggtggctcacaaccatctgtaacgagatctgactccctcttctggagtgtctgaagacagctacagtgtacttacatataataaataaataaataaataataataaaatactggaatgtatatgcatgtgtatgtggatcatgcttttagtacattaaagtactacattttagtacattaaaggatacttttaggatgtgcattgctcagtatttgtagatagatacactttgttctttttagcaggctcatagtttcccattgtgtaggtgtacttgaactgccctgtgtttttgttttcttgttgcaagtaaatgttgcattgaacatctttgtaagtttttgagtaccatgtcacctgtgttagtatactggtaggaattatttcttaaagtaattttggaagggcatatatgttttattaaagttttatttttattactttaaattatatgtaggtatatgtgtctgcatttgggtttgggtatgtgcatataagtacaagtgtcaaggaggccaaaagcataggaccccttgcagttgaaattagaggtggttctgagtcacctgatttatgttggggttagaatttgggtccttaggaagagcagcaagggctcctatgctggaccatctctctagccctggatgtatacagcttaaattttaattgataatgccacatttcttgctaatagtatgcatcctctttcccaaacttggtatcacccttctcctctcaaactttgtacctagctatgtaaaggtagaaaaatagctgctacttgtttttgttgttgttgttttatgttggattgttttcactttagaatatatagtatcttttacacatttttacttgcccttgttttataatagtattggctagaatcttcctacttagcccctttctcagccagccactacagctctccctagaatgacagtatattgttaattgttgtagctttttatgtatatactgtacagttatattgtaaagaatggatttggttcaatttctgagcataaaatttaagatcctagaatcttatatagtattatcttgtaatgaactaaaggctgactgttgtttgttttgtttgttttttgggttttcaaggcagggtttctcactttgtagaccaggctggcctcgaactcagaaatccgcctgcctctgcctcccgagtgctgggattaaaggcgtgcccggctaaggctgacagtttttaaggagctttaggatacatagtgtttactaggtagatgcaaccaggattagagggttgagactttcagagatactcctacctgaaacctcttaaagaagggaagagggaagccaggaagcagaggcccgcggatttctgagttcgaggccagcctggtctacagagtgagttccaggacagccagggctatacagagaaaccctgtctccagaaaaaccaaaaccaaaacaaccccccccccaaaaaaaaaaaaaacaacaaggaagagaagagggaacaagggctaagttgattacttgtggcagaagagccatcatgaaaaccataaaggacagctttttagagcgcttccagataactgatcatgaggtttccgggaggatgatacagcctttcccttatgccttgttcatttttctttctggctctatttacttgtttacttacttagggtttatgagacagggtcccatgtagcccagaaggctctggagtttgttatgttgccaaggataactataaacttccaatcattctgtcttcacctttcaggtgccactatacccagcaactattttcttctcctaatggatgatttgtttagaaacaggacttcctgtataaaattaagaatttgttaagtaaaagtggtcatttaatttctcttagagaatgtgagagttgagacagagtctatgtaacatgctggctttgaattcataatcctggttcatttgcccagccttgtgagggttagtgtctggttttttttttttcgagacagggtttctctgtatagccctggctgtcctggaactcactttgtagaccaggctggcctcgaactcagaaatccgcctgcctctgcctcccgagtgctgggattaaaggcttgcgctaccacgcccggctttagtgtctggttttattgtattgtgttatatatgccttgttcggttgatgaccctgggaggaggaggtggtgggtttgtggggtggacctggaaggagatgtaggatgaagggactgagagaaagggaaggaggggaagttgcagtcaagatgtattgtttgaaagaataaaataaaataaaaaaaaaaccaaaaatatctagccgtcatactgcccgccccaacccctttggtaaatggatattctctacaaatgggtttatctgttaggaaactgggttttgatgtgggagggcagttgaaaagcaattgtaagccgggtggggtggcgcacgactttaatcccagcactcgggaggcagaggcaggcggatttctgagttcgaggccagcctggtctacaaagtgagttccaggacagccagggctatacagagaaaccctgactctaaaaaaacaaaaaacaaacaaaaaaagcaattgtaatatgtaattttggataagatggtgataacctttcaaaagcaagttaagatttttttgctgttggaaagttaagtaatagaggataggacacaataaaatgctgtggagacagcattaaaatgtgtccttggtcagtttttcttttgtagaactcggttgattaaattcgcttttctgtaaaactatctaccgttttagaagtttaaaaaatgtacttgagtaataattcacttttgcttttgctatatataatttgtggattgtttgctgttactgtatactatttccttactgaataatgcatactgaaactactcccttacagaactccttatcactcttccttcttacaagtttacaaagataggctacagcagcagttactgcttaaatcacctgaaaggtacttctaaaatgtataactacaacacacataggagaaatgagggcaataaacttaaaatagtaaactataatgaagtttaactttagatctgttttgttgttgttgtttttgttctttttttttttttttcctgatacggtttctctgtatagccctggctgtccaggaactcactttgtagaccaggctggcctcgaactcagaaatccacctgcctctgcctcccgagtgctgggatcaaaggtgtgccccaccacgcccggctagatctgtttttaaattagaataatgtttacacctaaaacagaaagtcatttttgagaaattaagatagtagaagcctgctattatgcacatgaagcaggaagattactagtttgaggctatcttgggttcaaaagggaaccctgtttaggaaaacaaaaataagctgtgtgtgttagcatgtctttaattccagcagaggcaggtggatctatatgattttagggccagcatgatttatagcaagttgtaggccagtcagtgctacatagtgaaaacctttctcaaaatgaaaacatactacaaccccattaactacccccctccaaagtcccctcagtggaaggctatacagctataaaaatgagttgaagattggagaggtggttcccagcatcatggaacatgtgtacccacgtatatactaataaataaacatgaggtgtagtatagcttagtacatcttagacatgttaggtaagtgctctaactagagttaaattagttcactcctctcttttctttttcttttaaatcagtgccttaagtttcccaggattgtaattaactttgtatcttcttgctgagattacaggcctgtgacacagttaaattatatttaaactcattgagtagcatcaaaaattatatagtgaatttatccatataaaacattgcttttggctgtatttgcaagtgtgttctttaagacttgtaaataaggagagtgttgtggcatatgactttaatctcagcacttggaaggtgcaggcaggcagatctcttgtaagtttgaggccagtctggtctacatcatgagttccaggatagagttacatagtgagaccctatctcaaaacaaaacaaaagatttatttgtaaattgtttttcttagatttagatgtatttttcttgaggcaatattttatttggcatagagtaaatatttgccagtgcttacccattaattaatgttcagggaatccatgatattagtttgagtcatattgctgccttttacttggagggtaaaaaagtaattacttagccgggcagtggtagcgcatgcctttaatctcagcacttgggaggcagaggcaggccaacttctgagttcgaggccaacctggtctacagagtgagtttcaggacagccagggctacacagagaaaccctgtctcgaaaaaccaaaaaaaaaaaaaaaaaaagtaattacttctgatgttaaaaaatttaaggcaacaaaaatgaaattctcacatataaagtagtcattttaagtttgcagtactcgttgatattcataaataggcactatacactacataggtaccagatccactgttaagaaattatgtggcttttaggattatatgaaatatagaaataactagaaaagcttgtggtaggcaggtttctagacaaaattaacatactgtataaacagtcctatttcaggtaagtacaaatgccccttaaaggcatgtgactcaatgttaaatatgtttgagttctactaaatttaagcattgttacttgaaagcataaatgtcatttaatgttatcctcagttgattcagtttcttaattgtaaaatctcttctgagttcaacataacagttttaagaggcttgggtgtccagggacaggctactagaagacatggcagctgtacctactgacagtaggagagtctaatgtgtaaacttttttgttttttatttcaagattattttatactggggctggtgagatggctcagttggtaagagcacccgactgctcttccgaaggtccggagttcaaatcccagcaaccacatggtggctcacaaccatctgtaacaagatctgacgccctcttctggagtgtctgaagacagctacagtgtacttacatagagtaaataattaaattaaaaaaaaaaaaaaaaaaaagattattttatactactgttcagatagccctgctatttgttaatttgcatagtgatgacatttatgtttttaaccggacatatttttcatttttgtagataaagtggagaattttagtgaagaacatgaaaaaaatagtcaccactttcacaaaaatgctgaagatagtactaagaaacccaatgcagaaaccgcagtggcttctgaatataaagctgatgaaactaaagaaacaaatgatacttggaactcccagtctggaaaaagaacagagtctccatctgaaagttgtccagtcaaaggatctgtaagaactggtttatatgaatgggataatgattttgaagatatcaggtcagaagactgtattttaagtttggataatgagtctcttttggagatgaaagacgaggatttaaaaaatcggattggaggattggaaaatctaaatgaaacctttgaagaagatatcatacaaagtgttcttaggccaagcaactgtaggacgtactgtagggccaataaagcgagatcctcacagggagcatcaaattttgataagctaatggatggcaccagtcagtccttagccaaagcaaacagtgaatcaagtaaagatggcctgaatcaggcaaagaaaggtagtgcaagttgtgggaccagttttcgaggaacagttggacggactagagattacactgttttacatccatcttgcttgtcagtgtgtaatgttaccatccaggatactatggaacggagtatggatgagttcaccgcatccactcctgcagatttaggagaggctggccggctcagaaaaaaggcagatattgcaacctccaagaccactactagatttcgacctagtaatactaaatccaaaaaggatgttaaacttgaattttttggttttgaagatcatgatgagacaggaggtgatgaagggggttctggaagttctaattacaaaattaaatattttggctttgacgatctcagcgaaagtgaagatgatgatgatgacgactgtcaagtggaaagaaagaaagacaaaaaaagaactaaaacagctccatcaccttcccagcagcctcctcctgaaagcagcgacaattcccaggatagtcagtctagtactaataatgcaggtaagaattgtaagatgtatatataataaaaaataatatgtatttaatatataaaattttctcaggctttaattaaagggtaggctctttcctaaatattccattttagtttgaaatatataaaatttatttttaattacatgttgatgtgtgtgcctgcatgtggctatatgcatgtgagttcagggttccaaacccaatccaaattgcatgtaagtaagctctcccactgaaatataaccctaggctagcatatggtaatttatgtgataattttatactattgagtctttgggacagagataccaaacatcttgttttagttttgaaaatccaaatgtaatacagacataaggattgatttttttaggacatttagaactgtactgataacagatggttttatgagggaaatactcaaaagaaattaattaaaccctttggaagtagcacaaaacttgaaaaaaattgaaacattctcaaagcctcaaattgtggtctcataggattggaaagtactagtaggtaaggattctctcagttctctcaattctctctctctttgtctctctctttctctctctttttggttttcgaggcagggtttctctgtgtagccctggctgtcctggaactcactctgtagaccaggctggcctcaaactcagaaatccgcctgcctctgcctcctgagtgctgggattaaaggtgtgcaccaccactgctcacagtattctcttttaataataaaatttgtctcaagattgtaggctcaatgataaggtcctcttagtggttgagtctctagtgagagctaggtctatttttgtatcttggagcaatagaacttaaattctggagtatgaaacgttaagactcactttgagaaatgaagttgatattgaataacatttgaaaactataagactacttgaatgagaaacaccaagttacaggtcagtcttgatataacgtgtgaaccagcagtcatttttagaagatgaggttctcttccttctaaattagaagaaaatgtttataaccatttgagaagtaatctaatccttcagtagtttttatgtgaagactcacaggtcattgaactacattgtactagccaaggatagctatcttggttgtttctttgcctcctgactcagcctcccaagtgctaggattaggactgtgcaccactcccaaagattgtgctttttaaaattttgtcctctttggaactggagagatggctcagtggttacgtgtgtttgttgttcttagttcccagcacccacatagtggttcataacttcagttccagagaatctgatgccttaccatctctgcagtctccccaggcaggctcatatacctataccggacggttttgtgcactgtgtattcagatgctgatttctatgcctagacatctgcagtctggacaatggcatggccaagcatctccggtcttaatgttatgtaaaagttgtttcccatcacctctgattgggtaataaagagctgatcagctagttagctgctcagaaatagggcaggacttcctattccagtcctggaaagagactagagaggagagagggagaagatgtggagagaccatgtggataaaccaggaggattctccattgaggtctcttgagagagcagctatgaggacaaacatggactagagtgagccaaggcaagactcagatgtaggtaaaggaccacatagctgggaagtatacagcataaccaggttagatagaatagctctgaacctgcccagcttagtgcttgaagcttgttaataaaaataccaggtctctctgtcttttattcaggagctaaaatgggctagagtgggccctgcagttatatgagaacaaaaggggtgtaagaacatccccccaaagaattagttatgcaaaacactcatatataaatctttaaaaaactttttagagtagttatctttgtttagaagccatccagtgaattccaggccagctaattataagcacccattctcagtaaaagagaaaatgtttgatttttttgctgatagtacaaaaatacaactagaaaagatatgtaataggttttgaagtaagagaatagggttagagtacttcatcaaccactactatttttaatcctttattattttctccaacattaatgtttttaaaaaaccttgtgttttctgataacttgaaacactggaaagctagctagttttgattaccatttcagaaaacttggattttacagaggacttgcctggtgtgcctgagagtgtgaagaagcccataagtaaacaaggagataaatccaaggaaaataccagaaagatttttagtggccccaaacgggtaagtaaagcattaacactggtgttttttttttaataaaaatgtgtgtgtgtgtgtgtgtatgtatacatatatttatcattagagggctcaacccttaactttttattgggaagttaccaatgagccattgtgacattgtttatctcaggatatctgtaaatctttaaaaaaaaaccatatatatatattttttacgatgatatatatacatatatatatatatcattgtaaaaaatgtaatcatatgtctaaatatggcattaaaaataatttttctgggctggagagatggctcagtggttaagagcaccgtctgtttttccagaggtcctgaattcaattcccagcaaccaggtagtggctcacaactgtttataatgtgatctgatgccctcttctggggtgtctgaagacagcgacagtgtactcacttacataaaataaataaatctttaaaaaaataatttttccatgctctaaaatactggttgtttaaactgacatgaggctggttgggagctgagactttttgcttttctgtcttgtaatagtattctgccacatgtcactagtctagaaaaagaccagaattacaaaatacagtttctactaaattctagttgctttcatgtcatcctcagattgaacatttgtaagtcagggatcttctgtgtatctgtctttttgactttttccagttcttttagctatatacctacagtcataccatttgtcaagcttgctcagtaactgggaactgttttgcattccattttatattctcatcagcaatataggctctatcaatttccctcatgtcttggccaacatttactactagacaaaaattactataggcttgttgtgatggttcatgcctttaatcccaggcagaggctagcaagtctttgaatttaggaccaaccttgtctatatagtgaatgagttgaaggccagatacgtagtgagatcctgttgtaaaaaaagaaagttcccacaatagttatagagtagtcatgctttgatcttcatttctataatgaccactgagttagaaacttgttgcacatgctttctagtcattagtgagtctacatgtttgtgtattctgtgtgtgtgtatgtgtgtgtgtatatatatatatgtatgtgtgtgnnnnnnnnnnnnnnnnnnnnatatatatatatatatatatatatatatatgtttgtttgttctgcatgtgcctgtggatgtctcaagaccctatgaggcatcttcctctattgttccctaccttattttttgagacaggatttcactcagcctggagttcatagattcagctagactactactggccagcaaagcccagggaatcttcctgtttctacttttctagagtacaggcatgtgttactgtgcccagtttttatagaagtgctggaattgaactgaggtggtcatgcctgtatggaagtgctttactgactgagctgtctccctaaccctatttgtctgtattttgagaaattgctaattgaatctttttgccctttttaaaattaagggttatttttttatgtttagttgtaggagttcagtagatttttcaaaaaattaaaagaactaacatatgagcctgctgtctcactcctgggcatatacccagagaactccatacctgctgtggggatatttgtactctcaagttcattgctgcttttattgtagcagagaatttgtaatgagcatagttgtccatcaaaatatgattgaatatttggtgtgtgtatgtatgtaatagaatactattcagttgtaaagaaaactatgataaaaaatttcaggaaaatagatggacttagattaaaatacataatattagcctaggctatccactctcagaaagaaaaaaaccacattctctaaagtctagccaattgtgtgtgtgtgtttgtaaacaatgtgggcacatagtataacatgtaagaaagaaaaagaatgctaaatgttaggggatgagaaaagactgagtttctattctattatgtataaaagagcacttccctgagttgaataatgtttggggctactttttctgtgttttatattttttgttaattggcaatgttttgtataatgtaaaatttagttaaaaaaggaattccttattagatacataatttgcaaatattttgtctgcttcttaatgttacaccttcctctttgccaagtttaaaatttttaattatttttttcccttttgttgtctctggttttgatgtcacagccaagaattcattgccaaatttaatataggttttcaaaactgtttttcactcagggttttatagttttattcaggattttggtctatttgagtaatgtttgtttgtagatagggttttggttctctctgtgtaacagtcctggaacttgctttgtagacctggctagcactgcactggcaaagatcctgactccccagtgctgggactaaaaataagtgccaccactacctaacttgagtgaattgtggtgtgtgctataacgtggtgattgtggtccaccttcatttttatgcattgcagcatataatacctagcacaggtacagaatgtttcttgcatttaaaaagtctgctgtgttttgttcttgaacttgcagctaatagttttgtacttgctaattttatgtagctagaatgtaaactctttttattgtcttatatttctcttccttttatttctgtaaaagctcactgggtatcttcaaagtaattctagctgtttagatgcacttttagttcttacatacaaagtggtttttgatatatgttagttttcagagcattatttatcaacaggtgtgggggggtctcaatcactacttttttttttgtttgttttttttgtttttttgagacaggatttctctgtgtagaccaggctgacatcaactcagaaatctgcctgcctctgtctcccaagtgctgccctgctcatgacttctttacttactgataaagaaaatgacacacaaaatatgtatgtaaatttaaatgtcttgctgggtcctttagatttgctcaaatgtatatgtgtttagggttggttaatttacattctttttatttttttacgatttacttattttatgtatgtgagtacactgtagctgtatagatagatggttgtgagccttcatgtggttgttgggaattgacttttttgtgacctctgctcccttcagtcaaccctactcgctctggttggttctgctcgctctgggtcaattccgttcgatccagcccaaagatttatttattattatatataagtacactgtagctgacttcaaatgcatcagaagagggcgtcagatctcattacgtgtggttgtgagccaccatatggttgctgggatttgaactcaggaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggctttcccctgatttacgattttctaaaatgataaactaatgatttaactatttgtatgaaaaattattttcaaaccaaaaaagtagaagaataacaatactaaacctttatttttgtaaatctctgtagaggcagggtttaaaaaaaaaaaaaagacacttgaaggcttggtgtggtagccatgcatttaatcccagcactggggatgcaggggtaggtaaatcgctgagtttgaggccagccaggactacctgtgacttgggggagaacaattgtatttttctatctttgtattcagtatatttattgtgctatattggtagaaatatttgaagaaaatctaacataaatacgctatatggttacatttttaggtaagcttttgagatgtattttatatttggttcagtacaccaaaacttaaattttagttttttaaagattaacctatgtctgtaagcctttcagactgtttacattagaatattggttctccttacattttgaatatacattttatccatgcatgctttaaaaccatatattttatccatttggaaaatactagccaccctgagttgtgcaaactttctaaggtgacacattttgttaatgctcaatcaaatattcatgttaatatcaagccaaaaaattttgtcagtactaggaagcagtcaagattcacagtagtagatgaaggtttccagaattttagtttttgctagagttgatatttttttctcattggcatcaaatgccttaaagggattagctgacagtgatagtctcattttattcctttacagaaatatttttgccagataccaaagtcttaatcaggatgtttgtcagtctttgaagagtgatgtttctgataaacgtagatatatacagctcaaaaagttgttgtatgcaaaagtatttaatgcacatttgccacacagaacattgagatttaataaattgataattcttcttaggctttatatggagctcatggatatggtttgtggcagtgatgagaagtggtataatttgtaggtcatacagattcttgccaagacaacatcaaactggcttcagcaccatccacaggaatttcaacactgacaaaggcaaataacatcatactgtaattatgaaaatagttttgaatttgtagtctcctgaaagagtttgataaatctttagtgtccatggcctatactttgagacctgatgattgatagtattactttattctgttttcaaaatttttattgtgaaaacttcagatccaaaaagaaatatgaaacccctctactcttggcatgtatttatttttagctagtattttgctatcatgtattcttcctttctatataacaagtttattatacagtagtatcattcatatatatatatatatgtatatatatagtgtagtattaaaataatttcattgttagcataaatatttcttttattccttttttttttttttttttttttgtaaggctttctttgtgtagctctgtcctggaactttctccagaaatcaggctagcttaaaattcagagatcctctgcttctcagtgctgggattaaaagtgtgtgccaccactcccagtctaagcgcgtccctctctctctctctctctctctctctctctctctctctctctctctctctctctctgtctcaaatttagtgatttatttaatgtatgttgagtatactgtcttcagacacactctaagcattcttttttttttttttttttggtttttcgagacagggtttctctgtatagccctggctgtcctggaactcactttgtagaccaggctggcctcgaactcagaaatccacctgctttctgcctcccgagtgctgggattaaaggcgtgcgccaccacacctggccaccctaagcattcttaagaaaaaaaatttcaggctggagagatggctcagtagttaagagcactgactgctcttccagaggtcctgagttcaaatcccagcaaccacatggtggctcacaaccatctgtaatgggatctgatgccctcttctggtgtgtctgaagacagtgacactgtactcatgtacatgagataaagaaataaatcaatcttaaaaaaaagaaaaaagaaaaaaaaacttcctgtttactgataagattaaaacctataagaaaataaatgtattaaaaataattcttaatgctgatcatattgttttcatctaaagtcctcagaagtctttagttccccaccccttttaactaagactcttgtagcagttttgtatgttttgtttttatatagaccgtttcttatttacaaagaattccctttcacacccccccccccctttttttgtggtttttggttttttcgagacagggtttctctgtgtagccctggctgtcctggaactcactttgtagaccaggctgtcctcgaactcagaaatccgcctgcctctgtctcccgagtgctgggattaaaggcatgcgccaccacgcctggtgttttttgtgttttgctttgtgtgtgtgtgtgtgtgtgtgtgtgtgtgtgttttgttttgttttgtttttgttttcctttcacttatttttattaggaagctgtgatacttgtttttagggctgttccacatgtagaagttatctaattattttcttgatattatctgacttgctcttcactattggcttagaaagctgtacattaataaattctggattagatttaagttaattttttttccagagccagagacagcttcatttttgataattgctcatgtttccttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatttttaggaattagacttgaacataactgaatttaagtaaccttggttaagttttaagaattgatcatttgagctgggcagtggtggagcatgcctcccgcacttgggaggcagaggcaggcggatttctgagtttgaggccagcctggtctacagagtgagttccagaacagccagggctacacacagagagaaaccgtgtctcgaaaacaacaacaaaaaaaaaccaaccaaacaaacaaaaaaaaaaggaattgatatttggaaattgtggtgtaaattctggtgaaatgacaacctgtttctgatttctggataccaatttctctgcttcccactttttgcagctgtcgtgcctgtgctgaatcagagagaactgcttgctctgcctactttacactcaactcctccttacccctgtctgttgctaaggcagtgtttttataataattagccaaacttaccttcaatgcttggaaggttgcatttttcttggaatgttggctaccttgatttgcaattaagattgcttctgggtctttgaagaaactaatgtaagattagttgtggtttcaattttgaaatatttctaccactacttttcagtgttcctttgtagtttaaaactgggcccatctggccctatcttttgtctgactttctaaggaacattttggacttaatttttttctttccttctgtcattcaatatgacacttcatagtagcttctaggcagttggattaaaataatgttctctttataagtcaagagtacatatggctttctagtataagattgtaattgtatgagcttgtaattttaaagttgtatagatttataaattcttttttgttttctgaattagtttatataggttgttaatttaaaaacagaatctcgtaactgaagagactttaaaggacaagtactcccacatctcacccaagaacaaatgttcttccacacagtgcttgttttagcagttagaattcactctcccaaaacagcttgtttttgtccagtgtatttatttagtgagtgttgcttttctatttgaggatttacctcccatttttggatccagacatctaggtggtggtgatttctaaaaactagacacctgtgatgttaatgcacgtgaagcctgaataaaaggaagaccggaaccggcatggtgatgaggttgaggagtgtaaaactgcaaagtcatggctggctggctgtatttgatccagagtagttttattaagagttgggggatgggttctactctggctatggaagaaagtcagttcagttggctttcttcctttgtctttaggtaatgtatgctgctctgtgtgcaagctgatcaggcataccagaagaaatttaaaaaaaaagtctttaaagctcactacaatgtttctccaaactggaattttaaatagttttagcattatctttctcttataggaataatatttgaacactaaactaggcattctaaattcctgatgtgtgcaagtaatgaggtaaaatacttaggaaagttaaaatattttttctatataatccttttcttcattgtcttatttaaaatactactgaagtattactacttttagttttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgaaatcagaaatccctccctgcctctgcctcccaagtcctgggattaaaggcgtgcaccacccactgcccagtaggtaagcacttttctgggcaactataaggattagactttgaatccccatcatctgggatgggagaggcatgcatggtagtgcctataaccccctagcactgtggagttagaatttgggtacatcccaggaattcagttgacagccaatctagtcaattgttgagctcccggttcagtaaaagaccttgtctcctgtaagatggagctatagagaacacataacattgatttgtggtctctataaacatgcacacacaggcacacacactgcacatatactcacgttattcacaatttgtttacagacatacacttgccttttccccactaagatcaatggtgtaaagtcaaactgtacacaaattacttgggattagttctgtctgtctgccttttgatcagttagtctgtccttgatttatttggaatataagtaggtttcttggttcttctttgctttaaattttaatttttccctttgtttccattcttagtgaatgatataaataacattaacatttttcctaaagtaaaaactataaaaaaggtaaatttagttaaagatcaattcatttaagacctgttccacccaatttcctaccacttgtagggaacgcacacgcacatgcacacacgcacgcgcgcgcgcacacacacacacactctctcttgctttctattctcttctttctttctttctttcttttctttcttttctttcttcctttcctttcttacctttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccctccctccctccctccctcccttccttccttccttcccctctctccctctttcttgctttcttcctcccccccccctctttctttctttctttctgtaaaattttagccaggcattggtggcccacgcctttaatcccagcactcgggaggcagaggcaggcagatttctgagttcgaggactgcctggtctacaaagtgagttccaggacagccaaggctatacagagaaaccctgtctcgggaaaacaacaacaacaacaacaaacaaacaaacaaacaaaaaacaacaacaaaaaaccaacaacaacaaaaagtagtaaaatttactttttttattttgttgtgtaatttttgcttttcttgttcactgggtagcctaagacttgtagagctctttctgcctttgccttccaagtgctgggattaaaggtgatagccactactgcctggctgtttgaatttggcgcatataattcttcagaatggtaattgtgtaagcatgtgactgtagagtgtgcttttactttagtaatttatgtgtatgagtattttgcctgtatatatatatatttgtgcactgtatacatgtcttgctcctgttgaggccaaaagagagcataggatctcctggaactagagttgcagaccttatgtgagctgctatatgggtgctagtaatcaaatgtgggtctttaggaagagcagccagtataatctttacctatgagctttctttccacacccagttgttgctaaataatttatctgttcagagtgatcctaacctcaaaggaatgttatttaaaattattatcttgagctttgatatgcctgctttaaagtagatcataatgtacatttaagtgggtagcatatttttctttgagttcctaatttttgtttatgtagacatcctccgcaatgttggcttctttttctccctttcttccccttctctttttttctgttgctagtaaggcactatacctagacacacacagttactatgtattgcaactctttgaacattattcagatggacttatgctggtagagttacattactttgttcatgaaatccttgtagataagactgtgtgaagtatagccagttcactgtttctgtcatcactgtagtcttgagttgattttgtaaaaacacaaaatcatactataaaaatggtgggaatcctcccctccctcccccaacatgcatacttttagaggcctactcagtggagaagagcacaatggtcttattctttgctattcaggaaggaactttacttaagggaaaaaaaaaaaagatttatttttatgtgaatttgtgtttgttagatcacctggacctggaattacagacagttgtgagctgccaagtgggtgttgggagttgaacccagttcctctagaagagcagccagttttcttaattgctgagctgtcagaactctattttctttcatttataattgtaattcagtgaattggtctgctaaatcacactcttgagattgtcttcatacaaaaaccttgtatttatgttttcattgacagtcactcatgtataattgacccacatagattgatcatgggcttattttttattttttggtttttttcgagatagggtttctctgtatagccctggctgaccaggaactcactctgtagnnnnnnnnnnnnnnnnnnnnnnnnnnnnnnnnnnnnnnnnnnnnnnnnnnnnnnnnnnnnnnnnnnnnnnnnnnnnnnattaatgatgtgcatcacccctgtctggcaggcttgttattttttttaaccgtagtaaatttctgcatgtaaaatttttgtttgttgcatatattcctggagaagtaaataagaatgaacataggatgttgtaaggtggctgttttgaaacatgcttacttggttccagctcttgagaatgttagcatattcatgtgagctgtccactccttgttctgcgtattctgtagattagagagcaaacagaaagcagaaattgtctaacaagaagtacattaagaaaagtgaccaggcagtagtggcacatgcctttcataccagcacttgggaggtagaggcagaggcagaggcaggtggacttttgagtttgaggctagcctggtctacagagtgagttccaggaagccagggctacacagagaaaccctgtctcgaaaagccaaaataaataaataaataaataaaaataaatagaaagaaaagaaaagtgattaatgtgctatatatctactttttaaactaaaaaaagatggaagtcctggtagtccagtataagtgatctaattaagactcatctagagggggctggagaggtggcttagcagttaagagcgcagactgctcttccaaaggtcccaagttcaaatcccagcaaccacatggtggcttgcaaccatctgtaacaaaaaatctgatgccctcttctggagtgtctgaaaacagctacagtgtgcttacatataataaataaataaatattaaaaaaaaaaaagactcatccagatttctacatggcatttatgatcctatttttcttgaaaagttgactgctctttttaaaactatttttagttactctacaaaatcacttgtactgtgtaaaattagaaagtggcctatcagatgctctggtgtttacatacacaattcatattggagcaagtcgaattcttgtaccattattaggatgctattatgagctcaggggtcagttcactgttctctccttctctccttccctatctaacactcatatgttatttctttagatgcatttatctttagtagttttcctacctgataataagccctgcaactggccagagagataatggctcagtagtttcatcgtggctcacaaccattcataactccagttcagagtatctagcaccgtttttttgccctccatgagcactaggcatccacatcatatgtacacatacataaaggcaaatactaatacacataagtaaatctaaaaattttaaagcattatgattttgtaaaatttggaaataaaagtcaagagaaagttctaattttctttaacactagcattaaaatggcaagcatctaaaactttacaagtctaggctcatcaagttcatgctaaagatagtgtactagttggttttctcactgtgacagaataccgtacagcaagaagcagtccatggaggaagggtttgtttggctcccactttgaaggtacagttgtccatcctagtggacaagtcctagcagcaggagttgaggcagcttgctagactgcatccccgttcaggaatcagaaggacacatgctagtgcttagcttactttctccttttcatgcagtcctacactccagtccttggaattgtgctactcatattcaaggtgggtcttttcacttggaattagtgcctcactgctatgtctggtggcttgtttcttagatgattctagatcctgtcaagttggtggcattaaccatcacacagaatacaaaatttttttgctttggttttgagaaagttcatttagccctggctcaccttgaactctgtaggtgagactaattttgaactctttgctcctctatctcctgagtgttaagattacagacatgctaactttaaaaaaaaagtccttctcctgattcttattataaaacactttagtgccggcattccctttgctggtctgagtccctgtatgacggattctcttttttacctgaaggtgatggacttgggtagaccagtactaaaatagctatagtacttaaaataataattagtgttttgcctgatcttacagtgttttagttaagaatcttgtatttcgggctggtgagatggctcagtggttaagagcacccgactgctcttccgaaggtccggagttcaaatcccagcaaccacatggtggctcacaaccatctgtaacaagatctgactccactcttctggagtgtctgaagacagctacagtgtacttacatataataaataaataaataaatctaaaaaaaaaagaaaaagaaaattctagctggaattaaaaaaaaaaaagaatcttgtatttcccctgttgttttggtctgtggagaattagcctttttcttaacccaaagattattacctagagttagtcccagctcctacatggcaactcacaactgtctgtaattcacacatatggttcacatgtctataagaaggctaaacaccaactcataaaaaattaaaaattaaaaaaggtaaaaatcagtagaatttttgcactttgaaatacttttctctgtctttgactttatttcaatgctagcaatggaaatcagggcccttgttcatgctaggtaggtgcactaccagccatacttacacacaggacacagatttataccaaaagcatggaattgtgccttggactctgagtgtacatgaggtgttagaagttgctcaaataaagggtttaatgatgaacaaggataaaacttgtatggtgcttttctgagataacacgaataaagaggctagtttttagaatttgttaaatctattgtgtgcacatgtgacccagaaaacctgatcaagtcattgcatgagttcataaattatttaggtataataatgaatcattaattaatgtaaatctagtttataagattaatgggaggggctggagagatggctcagctgttaagagcactgactgctcttctgaaggtcctgagttcaaatcccaccaaccaaatggtagttcaaaaccacccataatgagatcagacaccctcttctggagtgtctgaagacagctacagtgtatttacatataataaataaatctttaaagagtaaatgggaacaggagtaatttggccattcttgaagtaggtttttgtgcaagtacttattttgtatatgtagcataaaaaggaggaagattaccatcataaacagaagcattagtcagatcagagacttgagggttagagtgaggacagttagtgtcacatcttctttgaagaatagaaatggtgtttctcttgtcattcttttttgaaatcagtttccttttgaaaataaagtttcattttttttctttatacaaatgtagtcctatgcatttgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcaagacctggaagagcagtcagtgctcttaaccactgagccatctctccagccctgggcagttcttctatagaaataaatagtagggctccagatgcagttttttatgtgggttaagtctgagacttaactccatttgtcaggctggtactactagaacttgtattcaatgagatatttctttatccccaaggaagtactttataacaaacaaaaaaaaggttcacagtgctgaaatttgttaccattactttaggaagttagactcccattaagtgatgatttgttattagtctaaataatttatgaatttatgcaatgaccttattaggttttctgggtaatgtgtatagtgtagatgaaacataaactctctgtttttatgttcctcttagaaaactgttgtatatagtctgtgtgtgttggcaattttaagtcttttttttcttctggttaattggtttcacagaagagtagttactggttctgtgctaaaaaccaaagtgattatgtccagcataggcatggtaatagcactcactgtttttggtctaagaatgtgtgtttatgcatttcagttattttatataaatgagacctttttgtaagggatacaaagtgaaatggaagcagttgattttttttttctttgtcatttcactagtcacctacaaaagctgtatataatgccaggcattggaaccatccagactcggaagaattgcctggaccaccaatagcaaaacctcagcgtgtcacagtaagtaaatattttttctttctcttaaaataaattagaaattaatctagatagctattatcttaatttttgttcttacaagattataattgaaagctttacaaattaaaactttgtagtagctcaaggccaatgtaggttttatactgagacccaatctcagaaactaaacaacaaaaaaaccaaaccagagcttttaatcatgactcatgttttatagaatttatagtatttagggcttaagaaaaattattccttatatgaagtgttagtactgatatgtgtgtgtggtattatgtatgtttttgttttgttttggtttttgtttggttttttcgagacagggtttctctgtgtagccctggctgtcctggaactcactttgtagaccaggctggcttcgaactcagaaatccgcctgccactgcctcccaagtgctgggattaaaggcgtgtgccaccacacccggctttatgtgtgtatttttgtgagtgtgtgtacaggtgtgtatgtactcagtagaggataacttttatgagtaatttcttctagcatgtgggttctgtcaatcaaactcagcaggcatccttacctgctaagcagtctcattggccttggccttcaaggtcaaggtcaattttaatgacaaggtctcattaaatttggcttatttagctagattggtgagctccaagtatccaccagtctttataccataaactgctgtggtgctgtctgtctgtctgcctgcctttctttctttctttctttctttctttctttctttctttctttctttctttctttctttctttcgttctttcgttctcccccccccctttttttttttggtttaagagtatagataccaagtatccaaaccctcatatccttatgcttgcatggcagacactttacttactctcagcttattgatcctgagaatttataataaatctaggcatgatggccaatacctgtaattgtagtacttggaaggctgaagtaggtatcaccaccttgtcactaacaagtgctgcatagcaagacctcactctttctcccaaagctatatatagactatattctacaacttgtggacctttttttttttttaaagtttggggcctctgcctttttaagaattattttgtttttattttatatgtaagagtgttttgcctgaatatttattattgtatagctccttttttgtttggttggttttggttgtttttgtttttgttttttttggagacaggatttctctgtggtatctttggctgtcctggaacttattctgtagaccaggctggtcttgaacttaaagagcattctaagtgctgggattaaaggtgttcttcacttctgcctggtgactatatctgtatatcttaaagtgactttcattccttaatttgatttacatagagctaaaattacattcaattaatactttccaaaccttttgtaaaatattcttgctaggtatgctacccacaatctaggcaactaggagatgaagcccttggtcatcttgaagtaccacaggaatgagttcttagaacagtaacaaaaatgtgaggctcgagggtcatgtgtttgtgttgctaatgactgaacccaggccctgtgcacagacctaatgttcatcctcagctctaagaatggaggagctcttttggttttttgacaaggtttctctgtgtagccctggctgtcctggaactcactctgtagaccaggctggcctcgaactcagaaatccgcctgcctctgcctcccaagtatcaggattaaaggcgtgcaccaccactgccctgctagaatagaattcttaataaacactataatgttttttcttaagttgattatgaagtcaccatcatatatactagtaattatttgtgattctgacacacgctttgttctttttacaacttactatttttgttctgtgttgctttagtttcctatgcttctgtgattccctttgtcgtcgttttttgaagccctgtcttaactgcttatcaatgctacttatgcatgcagttgtggttctttattctgttaactgtcctggaagcaaagaaatgataggaaatgtgaagtttttaaaaaaccaaaagtatttctcaagtggttcttttgggtataaatcaaaatttaagtcttagtagtgcatggaatttaaattatttcttaggaactttcagcagcctccctcttccccctttaaaaaattttcatttacttttttaaagctaaatttgtcacatagacaagatgttaccttttaaaatatatttgcttagaacaactaatttaatacctttattaataggtgaggctgtcttcaaaggaaccaaatcaaaaagatgatggagtttttaaggctcctgcaccaccactcaaagtgataaaaactgtgacaatacctactcagccctaccaagaaatagttactgcactgaaatgcagaaaagaagacaaagaagtaagcagccatatactgtttcactgcacgtggatagatttctatgtgtaacaattagccttttgtcttaaacaaatatcactacattgctagccacattttgaaccacaaacgtaccttattctacttgtccaatactagtgattcaaaaacattttttttgttgccatcgaatgagtgattttataggcattttattaaatataatgagcctatagatttaaatatgctaaagttaccaagaggcgggcttatgtttttcttggcagttatatactgttgttcagcacgtgaaacacttcaatgatgtggtggaatttggtgaaaatcaagagttcactgatgacattgaatacttgttaagtggcttaaagagtactcagcctctaaacacacgttgccttaggtaagatcttaattgtactttctataatgttgtgcatgctatgtcattaagtttttcaactggatgggtttaaatttgttaataaagctaggcatgtaaaaaatcttggtgttgataattagccatatgcttttcagtttccagatgctacaagattaaataatatatactaagtaatctgagatgggttttttgtttttaatctcagaatttaagccactgactgatagattgatttgagtagtgacgtgggtcatcttttatatatggtgatagattgaatattgtatactttttgagttggttgtattatctatgatcagttgaaatatatccaataaaatataactacttctagttttaaaataatagcagtattatgactatgaaaaggaactagaattggtgattggagaaatacactacagaaactgtgctaatcatttttataaatttatgcccattcataatctaagccttggtacatgttttaaaattttggtttgcccgtggtttttatattttgtgttgtcaatattttaagccttctacttctttcttgtttggaattatggaaactacagctaatgtcttagcagtttttagctgccttaacatagtctgtttccttctagtgttatcagcttagctactaaatgtgccatgcccagttttcggatgcatctgagggcacatgggatggttgcaatggtctttaaaactttggatgattcccagcatcatcaggtaggtattttttaagtttctggggttgagaagtattattaaaaaaattacagtttttgtctatatcagaaaatactttcactagacattcatataagtgaattaaaggttgagtttattttatttgcttgataagtagagatgatagccatacatttttgctttatatatctcattttcttgaagacgtttttcttaagaaaagtttgtttatattaaaatactattcatttgtcagttagcatattatactgaatattttatactataaaatgatttcctttattcagaagttttaaaatattgtttgatagtaattgcatagaaaagggttttgaattacagccatggggctggagagatggctcagtggttaagagtactgactgctcttccagaggtcctgagttcaattcccagcaaccacctggtggctcacaaccatctgtaatgggatcggttgctctctgctagtattcgggtgtacatgcagatagaacactcatatacattaaataaatataaatcaatctctttaaaaaaatatagccataactttaaagtacttagctcattgttggatccggaaaaaagctgcattctcaaaagtaataaatggtaaagattaacgaaccaaagttaattcttaatgtcaccataagttagaaaaaaatagtcattaccaaacctgacagtgatatattgaggtggccttctatgaaaggaaattactttctaaatacaaattgagtggcacaaaattaatctaataccaattcttctgaaactaaaagttatgaaattaaagtgagcgaacattcctctgtacccaggttgtacttgacacagaataatgaggacaataaggcacaaggaatgtgttacttgctttattgactagttaggtatagtcttaagataaaactttttcttagtgacttcttaaggtcttaactgtgacattctaatttccagaaatacactttataaacgtttaatcagggggactgaaaagataattaagcaataaagatcctgatttggtttttacccatgtaagggagctcacaaccacctgtgactctagctccaagtttctggtctttttgagcaattacacctatatggtgtgtgtgcatatttctctctctctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagttccaatgctacatagtgaaactgtgtctcaagaactccaactacacacctaacaaagatgtgtcaggtttggtggcacataagcaagtagatctccatgctgatttggtctccatagcgagttccaggccatccggactatgttgtgagaccctgtctttaaaaaaatgtcgttgaattaaaacattttttaaaaatccagcctttaagtccagcactgaggagggaggcagggataggttgacctctgtgagttcgaggccagctttgcctaaatagtggacaggaccaccagagctctgtcttgaaaaccttaaaaaaaaaaaaagggtatgcttgtttctttttaaaagttagtttatgagtgttttgcttgcttgtgtgtctggtgcttgcaagaggccaatagagttagaaatagttgtcagtgagccaccctgtgggtgcttggaatagaactggggtcccctggaagaacagctaatgcccactctttctgctgagtcatctcctcagcctcctagttaaatttatttcagtcccctgtattctgatggaaggcttaaattgtctatattttatggagggaaaattgtgttttgatacaaagtataaacatatttgttactttttttttttaaagaaaacaaaacttgacatacctttatgcacaaagaacattaaaggtatattgcaaaaggaaatatttataaattacataattcataaaaatgttccatatgtacctcatttaataaaactgttcaaagaaatgggtagcgaaggatgatagagaggaaagcacaactttaaatcagagttttatttatcaaatagctatgtttccctaggctattttgaaagagcagtaaatcaagcattatcagggtctctatcaaaaccatctataggaatattagacaatttagcttataaatgtcagtaatgtccttgtttctgaagttgttagtaattgctttcatgaatatttctcttttggggtctgttgaagaatctgtccctctgtacagctgctctcatgtacatattgagtagagaccgtttgaacatggatcttgatagggccagcctagatctcatgattcggcttttggagttggaacaagatgcctcttcagctaagctactgaatgaaaaagacatgaacaagatcaaagaaaagatccgaagactctgtgaaactgtgcacaacaagcatcttgatctagaaaacataacggtgggttgtaaaccttttatttttaagtaatatatattctgtttcaaatatacatgacaaggtggaaacttctctcttgaagtgtttaagtttgggttgggtttgggggacagataaaaacttcctttaagtctttgctaattattcttcctagattgcaagggattagcaggctgaaggataactaactaaatcactgccttcagccctgctgattatttcttctattagggctaaacttcctttattatatcaagaattagattactctctgttgagaagtggctttaggcttttttctccacttctctgctcattttttactttcgtaaagttggctcttttttaatcatactttgccttaaactttatactatagtgtggctcactgataagtatgtgggaaaattttcatgtttactatgttctgaaactataaatccagatggttagcactctaacttcaggctgttgaaactaatgaccgttgagtttgaacatttagggccactgacgttcccatactttcctccttgaagtttatcttactacattctttttgataggtcaatccaatatattgatttatagaaaagaaagtcgggtgtggtggttgcaagccttttaatctgagcacttgggaggcagaggcaggcaggtttctgtgagtttaaggtcagcctggtctacaaagtgagtccaagacagccagggctgagcctctgtattgccattatatattatatgaaactaacaaaaagtagattacttttaaatgaatttttttcatgaaagcaagctgtatagttaaatcaccgtttctttagtgtacactgattaaaattagtttattcacctataaaagcacatactgttctatttttgacttactggaatcttaataaagaaaaataaatcctaaaattaatgcatcagaattattctaaccttgtggtggcgcacacctttaatcccagcattctggagagagaggcaggcggatctctgagtttgaggtaagcctggtctacagagtgagttccaggactgtcagggatacacagagaatcctgtctcaaaaaaatcagaaaaaaaaaaaattattttacacctcagtattcattaatggtatttctgaattttagactggtcatttagctatggagacattgctgtccctcacttccaaacgagcaggagattggtttaaagaagagctccgacttctgggtggtctggatcatattgtagataaaggtctgtatacatacatgcatacatactgtagataaaggtctgtgtatgtacatgcacacacagagtgttatataacttgagtcccagtacttaggagacaggcaggtggatcttttgagtttgaggccagcctagtctacaaaaccagttctaggacagccagggctacatagaagagaaatactgtcttgtaagcacaaaattggagacactgtgatcaaggcaatttatagaaaaagtttattgtgagctcacagtttcagaggatgagtctagaatgagcatggcagtaagcaggcaagtgctggagcagtagctaagagttcagatcttgccgggcgtggtggcacacacctttaatcccagcactcgggaggcagaggcaaggggatttctgagtttgaggccagccgggtgaaacaaagtgagttccaggacagctagggcttatacagagaaaccctgtctcaaaaaacaaaacaaaacaaaacaaaacaaaacaaaacaaaacaaaaaatatataagcaccgaggagggagatgactgggaatgtcctgagtgctttgaaaccttagagcccatccatattacaggcctcctctgacaagcaaatatctcctaatccttcctaaacagtcacacagctattgaccaagcctccagatacatgatcctgtggggtccattttcattcaaaccattgtacttaactagcatcaggcataaaattatgttcccattccagcatatacgtattcatagcatgtatgtaggtaacgtttggtgttagctaagaaataattattgaactttcatatactaacttttgtctatttgttcttgcctagtaaaagagtgtgtggatcatttaagtagagatgatgaggacgaagagaaactagtagcctcattatggggagcagagagatgtttacgagttttagagagtgtaagtatgggcagctggacggggagttatctctacttgagattgtatgaccacttgatgttttaaatatcccgggggttttttacctttgcttatctgaattaaagttgtaaggattcttttcaaaaccaactgtcagtaaatgggcattttatcattttaagaatgtattgttttgctgtatatgctgataaatacttgtgatcctaaagttggaaaggaagattgtgagttcaaggccagcatgggccacataaataagaccctgtctcaaaccaaaagcttttatttgtatattattgctttaaatcaaaggtgcatacaagtttttttttttttacatgtatgtgactatagttttcttaatacagaaatctgtttttgttaaaacacgaacttgtttatcaaacaaacacagtcatgtcatggctttgttttagttagtacgcttttgtttgtttagtttttaagtcagattataagcacagctaaaaatgtttatttgactttggaaaataacactgttgggtgacagtacgtatgttttggtctttgattttaaatgacttaacctagttcagcacaggctacaattttactaacagtgaattttagaatttataattgctgattaagtagattggttaggtacttttaaaaacatggaagagctcttggcatatataaataaaattgctccttgtagggtgctgtttactaggttatacattatttctttatttaaaatacttaaatgactggctaaattggcacacatctttattctcaacacttggaaggcgggtgagtttctgtgagttaaagatcagcctgaacttcatagtaaattccaggatagccagggctatgtagagagatcatatctcaaataaataaacagacattaaaaagtaaaatatttcaaatatatttatgaattttaaagtatcaaatctgtatattggaggttttctgcatttcaaagtacttgacagttatgtgtaagttattatgagagtggtgtctttattgtatgataaattagtagtttttagttgggatcgcactgtgtaactttagctcacgtgtagttcactatgtataccaagatgtttttgaactcacagatgagcctgcctcatgagtgttgaaattaaagatgtgtgctacattctggttagtagttctcttattttaaatattgaagctataggttgtacaggtatttctctgcatcagggcttcataaactttgccatctatagcccatttttgcccagtaaattttaatgtgacccccaatatattggcaatactaaataggtacataatacaaaaagttttaaaattaaacccaagacagaatcaataaataacaatttggttttagttttggttggttggtttgttagtttgttttttgagacagagtctttatatatagtcctaactgccctagtacttgctatgtagaccaaccttgcctcagactcagggatgcacctatctctgcctcctgagtgctaggattaaagctcgtactaccatgcccagctattaaacagtaatttttaaagtcagtcattttgacacagtatataacccatgggtataccagtttgatacatactgaggaaaccattaagtctttgttatatttaatcaagtgactcattttataagaccagataattttgtgtatattataatatatagcataaaacagacgtgtttcttagctgtttgagcagtgtttgttggtgtgtgacatgacaacacacatgatgcaaaatgttcatgttgtgtcgtagaactaagtgaattcattaaatgagccatgggtgataagcatttctaacaacattttaggattcattatgcatttgatttttaatgaatttggttcattaaaaatgagaaattttctatactgcctgctttttcagtcctcgcatttaattacacctctgtaggtcagaactggagtttaagaaattgtgcccttagatgacaagatctgtttcatctttttatattttaagttatcaggtaaagtgtggtattatttatataaatgaaaattatggattgttagagtcattttatatccatcccttctaggtaacagtgcataatccagagaatcaaagctacttgatagcctataaagattcacaactcattatttcatcagctaagtaagttttataaactctcatttatttaaaactcaggaaataaagatgtattctattttttcttaaaatgttttgtctgttgagttttgtgaatatgtacattataggtaaaaagttaagagtgaagattcttgaggtaaaatggtttggtgagaattgtacatcctttatgttagctataatccaggacaaatgacttgttacaaggtgtttgtgggcagggcaagaagcctgggtactaggatggttttcatcactaaacaagtagatatatcttagcatatactaccatatatacattttttacagtgtatatataatacatgcaaagatgatgtttgttaatacattttaagtgattttaaggtgtatgtacaatatatataaaagaatcaaattctttaagcctactagaacattgcttagtatattgtcaatggtaaatattttaggccttttgtttgaagtggattgtaactccatttctgccacgtatttatatctcattttccagatctttgtctatctccctgactagccttcacaattaggctagtgctgccacctcagtgctctgtgtctctagtcctggttctgtctgattacaacagctgcttcttgctatcactgtcctagattttgctagctctgtcctagttctctggcctttatcttagccattatgccaccgggatttaactttctctggatctctgctttgaaaaactaatcttaagttgcaattctatatgacccttggctgtctttgtaaatttccttatacaagaacaactattttagtgtgaatggtccggtttatttgtgtattaaccttttatttggagagtttcaaattaagagacatatagactgaataatgtgataaactcttatacttagcttgaataatacatgggtgaaccttgtttctgtctataacctcatcttttgtgttattttgaagcaagctatatcatctccatttcctgttttaatgtaattttgttaattttatagcacattattatccttaacataagcaattcttccttatcaaggaacttccttgaagattaaatatgttttgcattgtattttatttggcgggtggtggttggggttggttgattgatttgtttgttttttagtagcagtagaaatggaacctatgcttataccagccaagtggtctgtcagtcctagtccctggttttttgtttgtttgtttgttttttcatttaaaaatattattcgtgattttaaagttgttttcttatgcttcttagtctctgagaattgccttagtaaagaagtatttaatgtgacatatttcatctcttgcatggggttttcttgtgaaatgtttgtagaagtggtgataaaagtcagaattgggttttgggaaatagcattcacctatagctttcaagaaaacacttatagatacttagtaatatttagcacagacagtttagttactaatagcaacagggaaatgttgtcaacatcctcaaacattaaagaagcaaattttttaggtttgacagtaaaagaacatctttctaaccaagaactgtaaaatattaggaaccttacaggatttcctcattgcatattaaaaataagctaggaatagattaaatatgtagaatttttctttacgggtttgatgtggtatgcaattcatgaaaaataaactgacaacgccagtttacttgatctgtgttagacttgaaaaaaaaatagtggatttgatggttgaaagatgccttggcagctggagcgatgactcagcaggtaaagaaacttgtagtatagacttgaccagaaaccatgcaaagctttaagacgtgcatctactctacaaagttgtcttctgacctccatatgggtgatatggaatctttgcttacacacatatcatacacacttattaaaaataatcagaatttacagatagacttgtgttagcattctacttccttgttagtgtgtgtcagacttgggaatcattggatgtagctgccagaagacctgttaatgttcctcaattaaaaataatgatttgtcttaacatatgtcaggcatttatttgatagtcatctttatcgagtaactttttttttttaaagatttatttatttattatatgtaagtacactgtagctatcttcagacactccagaagagggagtcagatctcattacagatggttgtgagccaccatgtggttgctgggatttgaactccggaccttcggaagagcagtcgggtgctcttacccactgagccatctcaccagcccctcgagtgacttttatatatgatactctacctgctaagaaagcattctcttatttgctaaataacaactaactggaaccgagaactggcattatttcttcagggtttatgggcgggagcatcatggtgatatattttgtatttgaggtatctgtaaaatgtgacagctcctgtgagtaacacgtttgttttgtgagccccccccccccattgttgtggtgctaattgttggtgtgagacaggatgttattcttttgtcccagctagtaaaagtaaactcctaggctaaaacaaccctttgccttagccgcctctatagtggggactgtaaacatgatgcacaaacatggaatgaacttacaaccttaactgtctttagagagaaattgtaatgatcaagtatactaaaattttgcagttagcaaaattattagcatgtgtggtacattaacattgtaactttaaaaacaggaaaacaaaacaaacttagtatttttttaggccccagttaataaattataccataattatttacattttattttctcttaagagcattacagcattgtgaagacctgattcagcagtacaaccgtgctgagaacagcatctgtgtagcagacagtaaccctctgccttaccagaatgtaactaaccatgtgggcaaagcagtggaggactgcatgagggctataattggagtattgctcaatttaactaatgataatggtaagtaataatttcttatgttgcatttgcagataagctattctgtttttcatgtactgatttacaatattccttaatataattaacttgctcctatagtcataagctacttttagaactgcctagtaaattagtctttgaatatcaaaactctgtatttcattaaagaaatagttattttaaaataaaaattttagatgaatacttcgtagccgagtatagtgtttacacctataatcctaacttggggcaaggcaagggaggctcagtgcatgaggttaaagtcagtctgaactacgaagtgagtcaagcaggattagagtaaaactaggactaagaaaagaaaggaagggaaaacaaaacaaaaaaatcattttaatgtgattattagtgttatcaggaaggtttttgtttgcattcttcagagtggggcagcacaaagacaggagaacaagaaggactcataggcacagcgatgaactgtgttcttcaggttccaaagtacctacctcaggagcagagatttgatattcgagtgctggtaagttcaagtgtggtcactttgtaattgtacttatcatgtctttagatgatgaaactttgttttaatttggatttaagaatctgtcatttattataatctgttttgttttggtggatccttatgaacatcttcatatttttctgttcttaaaacatttttcatagacatagaagtataaatgaaatggtggttgataactcagggagctaagtggcttgtgcctgtcctcctagcactgtaaagagtagagtaggaggatggccgtgagtcaaggccaggccagactgtgccaacaataagacaggtctgcggttcatggaagccagctaaaagaaagaacagtgtctgtcttacatagtggttgcaaatggaaaaatgctgcttgacattttatttacactaagttatatatattacattcattaagttcttgtgtgtgatgattatatttttaaatgttttatagggattgggtctactcataaacctggtggagtatagtgcccggaatcgacactgccttgtcaacatgcaaacatcctgttcctttgattcctccttctctagtggagaaggcgatcatagtttaaggctagccggacaagttcatgctgttcaagctttagtgcaggtgagcagcagtgacataattgcatatcgtatggattctataaggtccactgtgcacttgaagtcagctgagctcctcagcctgacggtccagattccctgacagggtccctaggatcttcagagggttcttggaccagttttgagaaatgttcttttgttttgtcaaagttactatgctgtacatactgtcttcaaagtctgtagatttagcacaccttttaatgtctgcatttgatacttggataattctcattagtaacttggtacttttcccaaatagtgtgattgggtatattaggtgctttttgtgttgaacatcatagcaacgaaaagaaaaagtcattgaagagaagggatttggtatgtccgcttgtttgtatggatacctgatagatagtgaactatgaatagtcttccttacacacttcctccagcgataagaatgctaaggatgtaaagacctagttctagagcttctatatttattgtttatattttagctttttattggtcttccggttaattcatccagtatgtgtaggtttgtctatttctttggtttttaattttagaaatgggtagggatttttaaatttgcttttgttttgtttttgtttcccctttaatttccttggaaatgttacctggattaaagataattaatggagacttttaatcttggaattacaatataaatcattactagattacttaaaaacagtatttgtgccaggcgtggtggcgcacgcctttaatcccagcactcgggaggcagaggcaggcggatttctgagttcgaggccagcctggtctacaaagtgagttccaggacagccaagactacacagagaaaccctgtcttgaaaaaccaaaacaaacaaacagacaaaaaaaaacccagcatttgtacttcagttttggttttcagtaaatgtaggacaaaagctttttaaaatcagataattcttatttcaaacactatcacactatgtacatgttagtacttgatgtctactttttttttttttataatatctttctagggactcctgtgtccctctcacttctttaattataattgttgtacatgtgtttctttaattacaattgtaagtttatagtgttgttcatgtgtgtttagtgctaacctcaggattgactaacctcgtagtatctttttaatgattttcaaaaataatttttatcagctatttctcgaacgagagagagcagcacaattggcagaaagtaaaacagatgaattgattaaagatgctcctaccactcagcatgataagagtggagagtggcaagaaacaagtggagaaatacagtgggtatcaactgaaaagactgatggtgcagaggagaagcagaagaaggaggaggaggatgaagaacttgacctcaataaaggcatgttaacctgaagtagtaatagagtcacagtgagaataatggtttttgagttcttttttagcatttgattcgcatattgttataatttagttaatgcctttatagtttgtctaggtaagctttggaattacagtagttcttctgtctttgagcatggtgtgtcagtgagagatcacttttcttgtttggtgcttctcctttactctgtacagagcagcagctaagttgggcatgagagtgcacagcttaattctagcatgaggtaggctgaggcagaggaatgccacttggaggtcagcctgggttttttcaatgagactatgtttctaaagcagaagggtatgaatgtctgaggttcttttatctgcctcaccttaaactgaggcgttccatcaaaatttacagggagtagttctcagagcttactaggcaaagagtaataacatcctagctagaggcaataaatatccttactagtgaatttattgactacctactgtttttacgaattatatttgctgtatatatgtacattctgcataataactttttgtaactaaacctctgagattttgggggtttcttgtttgatttattgagacaaaaatctctatatagctctggctgtcttagaacttgttctgtagacctgtctggcttgtaatgtccaagaactccctcattagtattgggattaaggcctgtgctaccactgccccataaggctttgaaatttaatatattcaacactttccacttagattgatgctgagcctgttttctttctgttcggctattccttccctaagttctgatactcggtctcttacttgaagacctgtggttcaatctatcttatcaacttatttcagttggatgcattttatggcatttgttagaactatgtttcttgtttttatagtcacatgtatgtatgtgtatatatatatatgcatatgactgcatataggcacttcatagtcattttgtttatctgtttgtgcattgatgaatccctttgggttgttttaatactttttcactagtacagtgatattaattgttttccagtgtggtagcaccagcccatcaacaatatgtgagggttccagtttattcacaccttcaggactaccttgaaggatatttttcttagtcattttatttgatgaagaactttttgtttcatttacagctctctaaaaactgattgtttgtaacatctttgttttttggtctttttgtgtatttgaagaaatgtctatttgggtctcatgcctactttttaatctggttattggtcttttattatgaaattgaaagaattctttataaattctaaacatcttaccagattaatgtttatgtacttccacgttgtgaactgtcttccactttgttattggtgaccttctaaaaaccaatcttttaagtatgttgcactttcgtttttatatttgggtcacttattcttttttttttttaatttgagatactgaattgtacatgcatcatttttagtagcttttaaggtgataacagtataattgatgttatggggtctatatcagctttgcactgtaataactacttatttaactgttttcagcccttcagcatgctggcaaacacatggaggattgcatcgtagcctcctacacagccctgcttcttgggtgtctctgccaggaaagtccagtaagtagataatagttcagaagtgcctcttgtatctttgaagattttttgcaacagcttcatgccattaattaacctgatgcacttagtttaaaactttccctgttcatacatgctttttatttcagaagagcggctgactgtttagacagttttatttatttccctgtagaagaaaatgtcaagaatatttcaataacttcctagtggtttcctttaaactttttaaaaatagaatgtgaacatctttatttcctttgcattacaggcttttatagaaagatcggagatgtagtggcttgtttgttggtctttatgattttttagaactgatatatctgtcatactcaaaactgtttaagatgttaaaaagcaagctgggggagggggcctcaggatgtaactcaattactaatgtgcttgattagtgtgcctgaagccctgggtttagacccttctgccacgtaaactggttatgacagttatgcctacaacccagcatttgagagatgaaggtagttggatcagaaaaattattcttggcccacctgggcctagagacctggtctcacaaaaacttaattagatacttttaatgtcataccaaaggatttacatacaagaaattaaaatagtttgggatgttaaagactttaaaatatttcttgacctttttaaggatacattctaaagaaagaatgatttttgttataacagggaagttcttggtatggatgattaagtccctgctgttacctgtagttgatgtaaaagaagggagggtttaaaacctatgctcagctggccaagtcaaatttggctcattttagtggcgcagtggagtaacttgtcctgcacaggttttattgtcctttttcttggttaaaagcactcagcatgggctggagattcgggcgcagctcttaaaagcacttgatgcttttcagaggattgggagttcggttcctagcactcatgtcaagtggcttataaccatttatgagatcagctccaaggtatccagtgcctctggcctctaacaacacctgcactgtatgcacaaacccacatgcgcacatatatacacgcatatacacatatatacacatagttaaaaaccgtcaaaataaaatatttttatgtctataaaagcacttgtcatggtcataagtgatcatacttaaggtccaatctagtcaaataatgtcccacaggacctcctcctcattttctttttaagacatcatccttggacttcttaaccatctatctggctaagcattgggccacatgcttcaggctaggaatatgttggtagcttatgttcatcaggaattatccctgagaaatatgtgtctatttaactctgtagtcacacagaaggggaggttataggtattgggacagtctgttgccattggaaaaaacaaatttgaacatcaaatccacaatgtgaacaggatcttggaagcactgttagtgttccctttggaatatgtgccacaggtagtagtaggtaagtgaaaggtcagtagtagttgcctttatttctaattgttgtgattaatacattgggacagtcatgtttaagtgtattgataatagatcttgaagttgtattagtctgatgtgtgatcattatggataatctgtagcttttgtgtccctaaaaaggggtttctgaatttgttgacagtattgtggagttgttacagccacagatatggtatattatggcatattagttgttttgtcaatccttataattagaaaactagatattaccacaagtacaaagtgaattggctttcccattgtggaagtggaagagataaagcacacatataattacgggcagtaagctgtccctgttctgtggccccatgcttaggaagtgtaagaacgtctgataccattttctgtttacctaccttgactaccaatttgcactcactaccaatttgcactcactaccaatttgcactccctgctgttgttggttcttgcctctctgtattctttgactctagcacagtttcacaagatctagctttcttaatttatctctgtcttgtcaacggcaatggaatggtggattgacttgtcactttaagaacatacagttacgcctgcttctcttgtttaccaatgccagcatgccttttggatagctgttatgcttttcaaatagtccatgctatatttttcctctttgaacctcctgtactatgaatgttgtaatgtcctttccatggccactataaatgtctagttctatatccaagtaaagaggaatttgaactaatgaagtgctttcattcacatcatgggagctatttattattgtagagacatacttttttactgagcagtcattcagagttacctcaaccattcttttctccaccattatggatgtttacatgtgatgatgattggactacttttgtagatcatggttattttagcaggcctttaaatttaaacttctttggatggatgttttgtctgtataatagttttctttttattgctgtaaaaagatcatgaccaaaaggacttggagaggaaaaggtttatttcatcttacagtttatagtccactatgatgggaagttgccagaaactcctaggaatcctgcttactggcttgctcaactttttctacaatctaagaccacctgcctagaggtggttgtctgccccatcagttatcaatgaagaaaacaccccatagacttgtgtataggtcaatctgatggaagcaattcaattggtgttctttttctcaaggtgactctagtttgtggcaagttgacagaaaactagccagcatattctacatgtaagtctgtacatggagtgtcttgtgcctggaggccagaagggtattagatccaatggaactggagttaaagacaattatgagccattatatatatgtagatgctgggaatcaaacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctggaatttgccccataatttatcacaaatgataagttttaaagatttagttaatttttgtcttctaatttacctttgtagcatggagaattttctttcatctttctgttttataagcacctctgtgtgtagagtctgtctatatatttaattaactgtgcagtttatttcaaacctttctctgcattttcaaaactaaatattcacagatgtttctttgtacctttggctttggctagctttgttgtttcccctttgtttctgtgggtagggtggtatggagtggggaattgacccgaatgtttctgcacaataggtaagtgaatgtggactggaaatgacgtatgaattttggggtcctttgtagatgactacgggatatgtagcagagccaacagcatcaagtgagttacagtatcattttttaccagcttgactgtttttaatctgtttcttcagatcaatgtaactacagtaagggaatatcttccagaaggagatttctccataatgacagagatgcttaaaaagttcttaagcttcatgaatcttacggtaagtaacttttattgtatattgcagtttatatgagtttttgattattttccagacaaagtcttaacactgtagcccaggctggcaatccacatgtttcagccattggaccagtgggacctggctagtttatgtgtttttcaatttaaatgtaatacatcgaaggtgaaaataataatcccatagtgttgttcttccctgtggcaaaatagttaacataagcagcttacagaaggtacattttggtttatagttctaaatttttgtgtgtgtgtttttttttctgtttgtttttgtttttttgagacagggtttctctgtgtagccctggctgtcctggaactcaccctgtagaccaggctggcctcgaactcagaaatccgcctgcttctgcctctcaagtgctaggatcaaaggcgtgcgccaccaccaccaggctagttctaaaatttttagtcatgtgtggcaagagcagcgtggaagagcagagtggccagctaatagagaatgcctgtgtatctgctttctccttttattccagctgtgcttctaggctgtgggatgatgccacccacaaacagaaaactattgtggcagaatgttatattactaaggcaatgatttaatttcagtgtactctttactacgtagactttgatacttttttttgtttaccattttgttaagtattaactctaatttctctccttcccctcttagtgtgctgttggaacaacaggccagaagtctatctctagagtgattgaatatttggaacattgctagctgctttacctttgcttcaggtgcttggtaatgctgaagctatccttagacaaagaaaagacatgaaagaagtccttgaagatataccaagaacattcatcagtatcattcattcgtgtttggatttttatgatcacccgatttcttcatcatgcattctgcgtttgctaaatgacagttactacatcaatctgcagctatcaaaaatgagggaaaaggttcaggctgttaacaatcccatgcagtatttaaatacacttacttggcagagtctatacctgcccctgtttccttgctgtatttcaggcaaggtttaaagagggcaatttgtgctgctgttagtgcaactgctgtgtatgttgagccactgttgtcatgccagtcaggtgcaaaggcagcttagctactgaggtattgaatgttctgaggacattctagacaacagcttagatcctttttcaggctcatttgcttttgctttttgttgaatgattccaatcgtaaataaagcttttaataattttgtgaattttttggttgttgttccctgaactactgtctatatttaaaatgagatggaatccaaagacacaagggattaatagtatatttttttattcttgattaggtttgggtgttgaactatttttcacttctgagaccatgaccatattcaatgtcataccattatgtgtcatagctataggcacaagaaaacaaatagcagtttgagggaatattatgttatataagataatgtgccctgttaaaggattaagcaaaaatagacaaacccagggtagtttacacttaatgctggggaggctcttgaaacattgttacgttttgagggacgttctctagatatattttctaatgttcagttcagtaaatataataaggaagctaaaacaccaatgtggaatccgtttttccagatagcgtgtatattcttctatagagtgacaggatcaattgcataagcgcaaagccttaaaattgctggtgtagagaagacccttttttattcagattctatgttcatagagcaattgtttagaaaatggttgtggaacacacagaacatggtttatagggtaaatttcatagattgttttttctttttttttttttcttttttttttttgtattgttcagaccactggttatacattttctcctttttttattaattggcctgaggacaggctttccagagatgtttcattaatacttttaattacctttcagatagttacatcatgtttcttcattggatttgtaaaacttaaagccataaaaatattagtttggtgtgtattggggaaaatagctaaaagtctaactttgactcattttagactttgttatttccttgtataaagtaacaaaccggggctcttgtatccgtgccagctgtaatgtttttaaatgcagtggctgccttctattgtcttcctatttttgataatgcagattgttgggaaatctataaggaagtaactgactctaggcaaattgttttcttcctcctacccgcccaaccccctacccgtccgtcaccttttaggaacacagtatgccagtgtaatgtgggaaccattgagactgtatttgccctgagtaccaaactaatttagtgaatttttttttaaacatactggtaaatgatgtccacaaatttccttagatatattttaattaattgtcttaaaatacattgatatttattaatcattggatttggggacagatttttgactgtggcagatggtagggaacagaacagtaaacagttggatgagatcaatcagggcgaattacatttttctgttacactggtgatcatttgagaattgatttacctcagtgtttaacagtttttgttttgtttttaaaatactaactaattgtcaagcactgatgagatgcaggtttggtggggtgggctgtgaggaagacctcaccttaccaactgcagtgcgtctctgtgttttagcctcagagaactctcattctagggtacttgaggctgacttgcaaagtgactaaagttttaaggtaaccttttttccattgtaaatacttctgtaaatactaccagttggatattagaacagtaggatacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgatactttaaatacacacgttgtctttaacataagtctattgacctgttttggaggaagaagtctcagaacttgttaaggccagcacaccgtgtcatttgagcataagtgtccaatttttcttaaatattttatatacttgtaagtactggtctgaatggatgtagccgcttagcactttgggctggttagggatggtggttttctgagtgtatagttaaatccttagaatgccctctatgttacttgaaaacttttggctttctgaatatgacggtaaatttctttgcttttgaggtttgatagccattttttaagcttttaacttttttttttcttgttagccttaaagatttttaagatttacaagtatagtctcaaccttgccttacttgatttagtcgcaagagtagattacaggattttcccctgaattttgcagttcctctccccatttatacacatacacaagtgtaaagccacctgtgagagtggacaaatggtgcaggtgctagacttggaaagacctaaatcacacacgtggagtttgattcccagctctggtagttgctgttaagttggagcaaattctttttttttttaaagatttattttctgtgtgtgagtacaatgttgctgtcctcagtcacaccagaagagggctttggatcccattacagatggttgtgagccaccatgtggttgctgggaattgaactcaggatctctggaagagcagtcagtgttcctaaccaatgacacatctctccagccctgaagcaaattcttaaaactataatttacccagtttccttcattgaaaaatgggagacagtacagacctacctgatggttgtatagattaaatatgtgtgaaacattattataatgctccaaatttaatgtttattagtaagtgctagtttttacagttttttttttttccttttactatttctctgtaaaaaggtaaaaatgctctggaaatgaaatagagtgcttgtgactattaagggcattatatgtaacactggtgcctcacatcactgcagttgatggtttgtgcttttgacaccagattctccaaattactatttccaaacttggccttgttaatctcttcatgatgaatcataaagcagagggaaattgagcaaactttaatgctttctaaaatgtttcaggtctttttttttttttttctcccccttagaatgatcaaaaagaggtttggacaactctgttgatggcttccagatggagatataattaagtaccctatgtagaatgtctttgaacaaactcttgagtgttttggtcaaacctctttctctctctgacttctgtatatgtgtagtttgaattccccaagtgccatgtgctgctttaaggaatgttttcattctacctaggttgtacatctctaagaatttgctggctaaaatcatactacagagagtacatatgccaaacatgaccagaatgtctattgataatgactgttatagtgaatgtagacactgaacattccattgttaaggcagagattttgagattgattcaggagatactaaatgaaactacacggttacaggatttgttgatttagtagtttgtggtgaaggtgggtatcatcatgctcagagcaaacagcacagaaactgtagatagagcttgagttgctagagtagtcaaagcagaacactagacagaaggagaaacagtaacaaaaactagcaagaaatagcaaaatgggcttgtgtgagttttcctctggctctcacaaaagtaaaacatatcagaacaggaaaagtaattctgtctctgcaagagaaatagccaaagatgtcccctaaatgtcgtggtgactaattgtattaactcaaaactagttaaaaggtgagactgcgaaacaacctagagttgctgaatttaaatgacacattaagccgggcagtggtggtgcacacctttaatccagatacttgggagttcgaggccagcctggtgtagagtgagttccaggagagccagggctacacagagaaaccctgtctcaaaaataaacaaataaaagacacattaaagtggaaaaaaaggaaaaagtaaaaatacacaatgcaagtgctaatgaagtattgatgtaagacataatttagggctgagtaatgtatttctccaagagcattttgtaatcacgaggtgtggggtgtatacagaacacaacatcctaataccacagaagtgtttataagtatgtgataataacaatcatatcagtaggtaaattcacaaccatagtttcagattttaatacaacttcagcaagtaatagtatctcacagttgtgaacagaaaccatgaccaaggcaactcttacaaggacagcatttaattggagctgggttacaggtccagtccattatcattaatgccaaagcatggcacatccaggcagacatggaacaggagctgagagttctgcatcttcacctgaaggctgctaggagaatactggcccctacgtggttagaaggagacagaggcacacttccaacaaggctacacttaagagtgccaatgagccaggcatattcaaaccaccacattctacacatgagtctaagggggctatacctagtcataacataaaaaatatattcagtccagctttcaaagtccccacaagtctataacagtctcaacaatctttaaacgttcaaagtctcttctgagattcatccacttaactaatccccaatgcaagaccggaaagcagctgggcaaactccacactctgcatctccatggctgatgtcaatttggtcttcacatttccaactcttttcatttttgttgacaaactttttcttggtctggttccactacctgttaacagctttcttcagcaagtatcacatgactctggcgtctaacatcttgaggtcaactttacaacttcttgtttcaacatctgggaactacgcatgatctgacctctccatctctaccctctgtagcactctggttgactccaatccactgctgctgctgtgcttggtggtcattccatggccctggcatcttgaatatgctgggctcttctgctgcaactagtcttcaccaataacctctcataggctctcttcatggtcctcaacttctttccatcaccccttcagtcctgtgccatcaactgcaactgagactccacttttaccaatggccttccatggcctctcatagtgccaagactcagctgttcttcacgtcaccttcataccttcaaaacaaataccacctgggtgactcttacatgtttacaagtccagctgcagcagaaggtacaaccttggctatctctggaacacagctttgttatggtctcagaacacacttcctagaagattttcatctcagtgatactagtctcttcttcatctctgctaatttcttagctccagctaaccagcttcaaattatctcagaaagtcacttttgtttttgattaacaaccagagccacatggccaaagctgtcaagttctgctgcttgctgnnnnnnnnnnnnnnnnnnnntatcaccagctttctgctttccaactacttcactgcctaagcttggctatcctggaacttgctctgtagtttgaccatgaacacggagatgtgcatggctgtgtctcctgaatgctggaatgaaaggtgtgtaccaccactcctggatttttttctctacttggaacttgctctataccaggctaaccttaaactcagagatctgcttgcctctgtctcctgggattaaaggtataccaccatgtttggacctaggcttagctgagtgggatcttgtcccaagatgaccactcccttaatatgtttatcttcttgaacataggattcatcaccattttactttttggtgccccttttttacttgaaccatacattttacatcttacctttctcagcttgctccttttcattaaaaaacactcttcaccagactaaaccagagaacaaagcctctgctggactcttgtgacttcctttaatggaattaatataaatacacctcttaaccttagccttgagagaaggcaaaaagcagtcacattcctcaacaaaataccacaaaaacagtcttcaggccacatactgaaattcttcacttgaagccacttgggtcaggtctgcacaattcaactctctctcagcaagggagtcttcaatatgcctactaggttagccctacttaaagcattcctctgctttccaaatccgaagtctccaaattcacattcttccaaagaaaagaatgatcaggcctatggcagtaatacccaagtccctggtaccaacttctgtcttacagttttcattgctatgaagagacaccatagccaagacaacttttataaggccaacatttacttggggctggcttacaggttcagaggttcaattcattatcagtgcaggaacatgcatggcagggtccaggcaggcgtggtacaggagatgctgagagttctgcatcttcatctgaagattgctaggagaagactggctcccacgtgattaggaggagggtctcattgcccacctctacagtggcacacttccctttatttagcaaagccacacctactccaccaaggccatatcgcctaagagtgccactcgctgggccaagcatatttaaaccactataaatagcttagttttgttattttttaaatataagctggttgctgtagcacatacctataattctagctactcaggaggctatgtcaggccaattacgtaagtttaggagttaaaaggcctgtttggacaataacatgtctcaataagtatgtaattaaatgtgaagttacagaaaagttgagtggatgagttgccttaatctaatattcagaaaaattacattgaacatagatttttgtattgcatatgcaaatttcaccaagataatctgagagctcataaagcagacttctatgcatttcagatgactgaaggctacagagaatatacctgtgaatcagcaatcaaaaatcagaacaggcctggagagatggctcagcagttaagaacactgactgttcttccaaaggtcctgagttcaaatctcagcaaccacatggtggctcacaaccatccgtaatgaaagctgatgccctctgctggtgtgtgaaaaaacagctatgatgtacttacatgtaataaataaatcttcaaaaaaagtcaaaacaagcaacaattgcaaaccatattcagatattaagcagcatgggccagtgagtaagtaaaagcaagaaaagatcgtgccaattaaaatacaatacattggagggtttttttttttttactttgtttattgccacattaaaagcagtacttaaaattaaggctatcattgtgaacctgaaatgaaaagcatgaagtaatttaaaacccagtgtaagtttgaagaaagaaaaattagattagaaatcagcataataaacttgaaaacaaactgaaaatgcttaaaaaaaaaagttgagcccttaaaaccaaaaactgccagtgttgggaatgaaagatgaaataatacagagcctatggatattcaaaagaaataagatgttacaaataagccaaaaatctttacaactaaaattttagaattaattgagaaactttgaaaaatgacaaggtcaggccacattctgtggtatgtatgtgtaagcagtatttgggaggtggatgcaaaagaatcaagtttcaaaggctgtgtttagggagatagctacttgagacactgtcacacaaaaattgtgtgtgtgtgtgtgtatgtatgtataaagtaaaaaaggaacattaaaaaccaaggcaacatgtccccaaaggtactagttccacagaaatggtttccagtgacagatgaaatcgtagacaaagaattaaaaggataattataaatacatccaatgaagtcaaaagaaggcacaagtctaagaatacagtcagctgactgaaatgaagttgataggagttattaatgcagaagtcaatgtcgagctagaaagattgaagaattgctagaaatagacagtaaattaaaaggttttagggagtcacagatagaatggatcaaagattggttcagtgttggggatagaaggcaaggtagatgaaatgttcagacaaagataaagtacaaaataagatctatggggcactatctaaagaccaaacctataaattctggacctgggaaaatgagaatttcatgccggaggaatggaaaacattattttcaagaacacaattgtgattgaagtttccttaaacctaaagagatgcccgatcaagtacagaaagcataacaccaaatagataagaacagaagaaaccttcctgtatcatagctaaaacactaaaatacacaaaataaagcattgagagcttagagaaaggcaccaagtcaaatataaaggcacaccccttagagtagcaccgtaccgctctcaatagaaaggttggagggcttgagacgacgtattccaggctctagagcacaactgtcaacccagactactatacctagcagaactatcataactgaagaagaaaagagctttctgtgataaaagcagactaaaggaattcatgattacaaagcaactctacaaaaggtccttgaagtcctctagactgaagagaaagataaacacatcatggaagctacaagaaaaaccaaacaaaacagcaaatgaggcaaatggttagaaagtaatattaagagatagattgtgtggcgcacgcctttaattccagcactcgggaggcagaggcaggcggatttctgagtttgaggccagcttggtctacaaagtgagtttcaggtcagccagagctacacagagaaaccctgtctcgaaaaattaaaaaaaaaaaaaaaagattggtatatttggttcaacaggcaacaggatccatctattttttatctccaagaaatgtacctcaccatcagatgcaactttagtataaaacaaaagaaaaagatattctaagcaaatgctctaataggtaacaaaaattgacttcaaaattagaacctaactgaggtcactttagtgtctccccaattgtttgggggcactgtgtactttgagctagcctggaactcctgtttccccttcccgtctcacgggagtgctgggattgcagatgtgtgtcactgcatctgactttttgacatgggttctggggagcaaccttcagttgtaaggcttgaacatcaagcatctttactccttgagccatctggttggctatcaagacatgttaaaaaaaatattgatggaaacatcaggtaggtgggatacagcaaaatggggaagcctttgctatagctctcagattgttaggacagtcttataatttgaggtgatggaagccaggggtctgtctgtacattacacattaatttacctaatggtcacaggatatgtggtcacacacagagattggctttaaatagctatttttaggaaataaggtctctcagaataatttggctccaacctgtaacattccaactccccacaatcatggacattctaaatagtcaatcagatgtgtagaatgtttaacacagatacagtgttctcttccgttcctgagaacttcagttcacaaatctcatatgagaagaaagaagctaaagtgctggcagaagaaactttcctctgagaggacagggttagccagggccagaatccatggcaggctgcaaactgtcagtttgggagagtaggcctaagtttctgttttccagaatggaaaaagtccaaagcaaatcgattctaggaaaacccacccctcacggccagccaatcaggaagttactccaccacttagcctgagtcaacctcatggacagccaatcaggagctgtagaagctaccccaccaccaagtataattagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggggcggccatccacttttcctctatcagtttgttttctagtttcttataagatgcagtgaggttatgaatcttaatgtcccagataataaatactcgactcgaccccaactgtcggatttggaggatcatgaagtgtctgaccatgtatgtttaccatgtatgttcctggcactctcatataataaacactgggaaagatgaacagtgtacgttgctcgaggttgctagttgccagcaggacctctgagttgagcactggtgctgagggaagaatgctaacatcatcttagggtgttccttcatcttagttttggtatggtggtgaagctgatccctgggagcaggaactgggtagatctcaccctgactgacagttggattgtcatagaacttcagtgatctgctctgacttgggttttacgtgccataattttaaacgtgtacactgtaaggtgtacatcgaggatttcccttgactggttgtttcaaaaacagattgttcactgggcttatagcatagtgtactggctagttttgtgtcaacttgacacagctggagaaatcacagagaaaggagcttcagttgaggaaatgcctccatgagatccaactgtaaggcattttctcaattagtgatcaagggggaaaggccccttgtgggtggtgccatctctgggctggtagtcttggattctataagagagcaggctgagcaagccagaggaggcaagccagtaaagaacatccctccatggcctctgcatcagctcctgctccctgacttgtttgagttccagtcctgacttcctttggtgatgaacagcagcatggaagtgtaagccgaataaaccctttcctccccaacttgtttcttagtcatgatgtttgtgcaggaatagaaaccctgactaagacacatagccttctcatgtcatctacaaagaccaaaaattacagacagagagtggcaggatgttggcctaccaggaggaaaagaacctgttcttccaaggggagtttcctggggacactggtaccttatagttcctaccacgctatgtcaaatcaggtgtttctgactagccagggttctatctgttgactttattgcagtcttggttctgaatacacaacatgcatgcacaggccatgcttcatgcatgtaatgccaccaaaacaaacaaacaaaacaacaacaaaacagaaaacaaaaaaataggagaaagaaactgcttgaaacactttggttcacattagagtctactgtaagatatgatttgcagtgcttgtattttataaataaagctttctgctcttatagaaacaatacttatacaaaacaaaaccttttaccattttacagtacaacattctgaagttagtatatctttggattgtaatatgctagaatctttgattttaaaaattgtgggttgggctggtgaaatggctcagcggttaagagcactgactgctcttcaagaggtcctgagttcaattcccagcaaccacatggtggctcacaaccatctgtaatgagatctgacagccctcttctggagtatctaaagacagctacagtgtactcacatataattaaaaaaaaaaaaaagaatggcctgggtccaattcccagtgccacatagaactggacatggtgttacacacctgtaatcatagctagcacctgggaggcagaggtcagatgaaca

SEQ ID NO: 1548 - DNA, 5849 bp, Mus musculus
ggggccgggagcgcaaatggcgttgagatggttcagggccctgttcaaactccagcgctgaccattcaccggcggaggcggcggcgcagaaggcggcggcggcccagcgggggcacagcccctcgcctctctcggtggcaccggtcggcactggtctctcgcgcggggctcccgcgcccgcccgcgggccgttgggagcgggagaggcggaggcggcccgaggccaaagcacccgccaggcgccgaggggaatatgaaacaggtgtcaaaatgacatccagatttggaaaaacttacagtaggaaaggaggaaatggcagttcaaaatttgatgaagttttttccaacaaacggactactcttagtacaaaatggggtgagaccacatttatggctaaattagggcagaagaggcccaatttcaaaccagatattcaagaaattccgaagaaacctaaagtagaagaagaagatactggagatccctttggttttgatagtgatgatgagtctctacctgtttcttcaaaaaatttagcccagggtaagggttcatcttactcagaatctagtgaggctgctcagctggaagaagtcacttctgtatttgaagctaatagcaaatgtagtcatgtggtgggtgaagacagttttgcttccgacagatgcttacttgtggaggatactttaattgggaaagagaagagcataagtagaattccagaagacaacgcaaacaaaagtagttgcactaagttgctaacttcagataaagtggagaattttagtgaagaacatgaaaaaaatagtcaccactttcacaaaaatgctgaagatagtactaagaaacccaatgcagaaaccgcagtggcttctgaatataaagctgatgaaactaaagaaacaaatgatacttggaactcccagtctggaaaaagaacagagtctccatctgaaagttgtccagtcaaaggatctgtaagaactggtttatatgaatgggataatgattttgaagatatcaggtcagaagactgtattttaagtttggataatgagtctcttttggagatgaaagacgaggatttaaaaaatcggattggaggattggaaaatctaaatgaaacctttgaagaagatatcatacaaagtgttcttaggccaagcaactgtaggacgtactgtagggccaataaagcgagatcctcacagggagcatcaaattttgataagctaatggatggcaccagtcagtccttagccaaagcaaacagtgaatcaagtaaagatggcctgaatcaggcaaagaaaggtagtgcaagttgtgggaccagttttcgaggaacagttggacggactagagattacactgttttacatccatcttgcttgtcagtgtgtaatgttaccatccaggatactatggaacggagtatggatgagttcaccgcatccactcctgcagatttaggagaggctggccggctcagaaaaaaggcagatattgcaacctccaagaccactactagatttcgacctagtaatactaaatccaaaaaggatgttaaacttgaattttttggttttgaagatcatgatgagacaggaggtgatgaagggggttctggaagttctaattacaaaattaaatattttggctttgacgatctcagcgaaagtgaagatgatgatgatgacgactgtcaagtggaaagaaagaaagacaaaaaaagaactaaaacagctccatcaccttcccagcagcctcctcctgaaagcagcgacaattcccaggatagtcagtctagtactaataatgcagaaaacttggattttacagaggacttgcctggtgtgcctgagagtgtgaagaagcccataagtaaacaaggagataaatccaaggaaaataccagaaagatttttagtggccccaaacggtcacctacaaaagctgtatataatgccaggcattggaaccatccagactcggaagaattgcctggaccaccaatagcaaaacctcagcgtgtcacagtgaggctgtcttcaaaggaaccaaatcaaaaagatgatggagtttttaaggctcctgcaccaccactcaaagtgataaaaactgtgacaatacctactcagccctaccaagaaatagttactgcactgaaatgcagaaaagaagacaaagaattatatactgttgttcagcacgtgaaacacttcaatgatgtggtggaatttggtgaaaatcaagagttcactgatgacattgaatacttgttaagtggcttaaagagtactcagcctctaaacacacgttgccttagtgttatcagcttagctactaaatgtgccatgcccagttttcggatgcatctgagggcacatgggatggttgcaatggtctttaaaactttggatgattcccagcatcatcagaatctgtccctctgtacagctgctctcatgtacatattgagtagagaccgtttgaacatggatcttgatagggccagcctagatctcatgattcggcttttggagttggaacaagatgcctcttcagctaagctactgaatgaaaaagacatgaacaagatcaaagaaaagatccgaagactctgtgaaactgtgcacaacaagcatcttgatctagaaaacataacgactggtcatttagctatggagacattgctgtccctcacttccaaacgagcaggagattggtttaaagaagagctccgacttctgggtggtctggatcatattgtagataaagtaaaagagtgtgtggatcatttaagtagagatgatgaggacgaagagaaactagtagcctcattatggggagcagagagatgtttacgagttttagagagtgtaacagtgcataatccagagaatcaaagctacttgatagcctataaagattcacaactcattatttcatcagctaaagcattacagcattgtgaagacctgattcagcagtacaaccgtgctgagaacagcatctgtgtagcagacagtaaccctctgccttaccagaatgtaactaaccatgtgggcaaagcagtggaggactgcatgagggctataattggagtattgctcaatttaactaatgataatgagtggggcagcacaaagacaggagaacaagaaggactcataggcacagcgatgaactgtgttcttcaggttccaaagtacctacctcaggagcagagatttgatattcgagtgctgggattgggtctactcataaacctggtggagtatagtgcccggaatcgacactgccttgtcaacatgcaaacatcctgttcctttgattcctccttctctagtggagaaggcgatcatagtttaaggctagccggacaagttcatgctgttcaagctttagtgcagctatttctcgaacgagagagagcagcacaattggcagaaagtaaaacagatgaattgattaaagatgctcctaccactcagcatgataagagtggagagtggcaagaaacaagtggagaaatacagtgggtatcaactgaaaagactgatgcccttcagcatgctggcaaacacatggaggattgcatcgtagcctcctacacagccctgcttcttgggtgtctctgccaggaaagtccaatcaatgtaactacagtaagggaatatcttccagaaggagatttctccataatgacagagatgcttaaaaagttcttaagcttcatgaatcttacgtgtgctgttggaacaacaggccagaagtctatctctagagtgattgaatatttggaacattgctagctgctttacctttgcttcaggtgcttggtaatgctgaagctatccttagacaaagaaaagacatgaaagaagtccttgaagatataccaagaacattcatcagtatcattcattcgtgtttggatttttatgatcacccgatttcttcatcatgcattctgcgtttgctaaatgacagttactacatcaatctgcagctatcaaaaatgagggaaaaggttcaggctgttaacaatcccatgcagtatttaaatacacttacttggcagagtctatacctgcccctgtttccttgctgtatttcaggcaaggtttaaagagggcaatttgtgctgctgttagtgcaactgctgtgtatgttgagccactgttgtcatgccagtcaggtgcaaaggcagcttagctactgaggtattgaatgttctgaggacattctagacaacagcttagatcctttttcaggctcatttgcttttgctttttgttgaatgattccaatcgtaaataaagcttttaataattttgtgaattttttggttgttgttccctgaactactgtctatatttaaaatgagatggaatccaaagacacaagggattaatagtatatttttttattcttgattaggtttgggtgttgaactatttttcacttctgagaccatgaccatattcaatgtcataccattatgtgtcatagctataggcacaagaaaacaaatagcagtttgagggaatattatgttatataagataatgtgccctgttaaaggattaagcaaaaatagacaaacccagggtagtttacacttaatgctggggaggctcttgaaacattgttacgttttgagggacgttctctagatatattttctaatgttcagttcagtaaatatggttatacattttctcctttttttattaattggcctgaggacaggctttccagagatgtttcattaatacttttaattacctttcagatagttacatcatgtttcttcattggatttgtaaaacttaaagccataaaaatattagtttggtgtgtattggggaaaatagctaaaagtctaactttgactcattttagactttgttatttccttgtataaagtaacaaaccggggctcttgtatccgtgccagctgtaatgtttttaaatgcagtggctgccttctattgtcttcctatttttgataatgcagattgttgggaaatctataaggaagtaactgactctaggcaaattgttttcttcctcctacccgcccaaccccctacccgtccgtcaccttttaggaacacagtatgccagtgtaatgtgggaaccattgagactgtatttgccctgagtaccaaactaatttagtgaatttttttttaaacatactggtaaatgatgtccacaaatttccttagatatattttaattaattgtcttaaaatacattgatatttattaatcattggatttggggacagatttttgactgtggcagatggtagggaacagaacagtaaacagttggatgagatcaatcagggcgaattacatttttctgttacactggtgatcatttgagaattgatttacctcagtgtttaacagtttttgttttgtttttaaaatactaactaattgtcaagcactgatgagatgcaggtttggtggggtgggctgtgaggaagacctcaccttaccaactgcagtgcgtctctgtgttttagcctcagagaactctcattctagggtacttgaggctgacttgcaaagtgactaaagttttaaggtaaccttttttccattgtaaatacttctgtaaatactaccagttggatattagaacagtaggatacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgatactttaaatacacacgttgt

SEQ ID NO: 1549 - DNA, 3789 bp, Mus musculus
atggttcagggccctgttcaaactccagcgctgaccattcaccggcggaggcggcggcgcagaaggcggcggcggcccagcgggggcacagcccctcgcctctctcggtggcaccggtcggcactggtctctcgcgcggggctcccgcgcccgcccgcgggccgttgggagcgggagaggcggaggcggcccgaggccaaagcacccgccaggcgccgaggggaatatgaaacaggtgtcaaaatgacatccagatttggaaaaacttacagtaggaaaggaggaaatggcagttcaaaatttgatgaagttttttccaacaaacggactactcttagtacaaaatggggtgagaccacatttatggctaaattagggcagaagaggcccaatttcaaaccagatattcaagaaattccgaagaaacctaaagtagaagaagaagatactggagatccctttggttttgatagtgatgatgagtctctacctgtttcttcaaaaaatttagcccagggtaagggttcatcttactcagaatctagtgaggctgctcagctggaagaagtcacttctgtatttgaagctaatagcaaatgtagtcatgtggtgggtgaagacagttttgcttccgacagatgcttacttgtggaggatactttaattgggaaagagaagagcataagtagaattccagaagacaacgcaaacaaaagtagttgcactaagttgctaacttcagataaagtggagaattttagtgaagaacatgaaaaaaatagtcaccactttcacaaaaatgctgaagatagtactaagaaacccaatgcagaaaccgcagtggcttctgaatataaagctgatgaaactaaagaaacaaatgatacttggaactcccagtctggaaaaagaacagagtctccatctgaaagttgtccagtcaaaggatctgtaagaactggtttatatgaatgggataatgattttgaagatatcaggtcagaagactgtattttaagtttggataatgagtctcttttggagatgaaagacgaggatttaaaaaatcggattggaggattggaaaatctaaatgaaacctttgaagaagatatcatacaaagtgttcttaggccaagcaactgtaggacgtactgtagggccaataaagcgagatcctcacagggagcatcaaattttgataagctaatggatggcaccagtcagtccttagccaaagcaaacagtgaatcaagtaaagatggcctgaatcaggcaaagaaaggtagtgcaagttgtgggaccagttttcgaggaacagttggacggactagagattacactgttttacatccatcttgcttgtcagtgtgtaatgttaccatccaggatactatggaacggagtatggatgagttcaccgcatccactcctgcagatttaggagaggctggccggctcagaaaaaaggcagatattgcaacctccaagaccactactagatttcgacctagtaatactaaatccaaaaaggatgttaaacttgaattttttggttttgaagatcatgatgagacaggaggtgatgaagggggttctggaagttctaattacaaaattaaatattttggctttgacgatctcagcgaaagtgaagatgatgatgatgacgactgtcaagtggaaagaaagaaagacaaaaaaagaactaaaacagctccatcaccttcccagcagcctcctcctgaaagcagcgacaattcccaggatagtcagtctagtactaataatgcagaaaacttggattttacagaggacttgcctggtgtgcctgagagtgtgaagaagcccataagtaaacaaggagataaatccaaggaaaataccagaaagatttttagtggccccaaacggtcacctacaaaagctgtatataatgccaggcattggaaccatccagactcggaagaattgcctggaccaccaatagcaaaacctcagcgtgtcacagtgaggctgtcttcaaaggaaccaaatcaaaaagatgatggagtttttaaggctcctgcaccaccactcaaagtgataaaaactgtgacaatacctactcagccctaccaagaaatagttactgcactgaaatgcagaaaagaagacaaagaattatatactgttgttcagcacgtgaaacacttcaatgatgtggtggaatttggtgaaaatcaagagttcactgatgacattgaatacttgttaagtggcttaaagagtactcagcctctaaacacacgttgccttagtgttatcagcttagctactaaatgtgccatgcccagttttcggatgcatctgagggcacatgggatggttgcaatggtctttaaaactttggatgattcccagcatcatcagaatctgtccctctgtacagctgctctcatgtacatattgagtagagaccgtttgaacatggatcttgatagggccagcctagatctcatgattcggcttttggagttggaacaagatgcctcttcagctaagctactgaatgaaaaagacatgaacaagatcaaagaaaagatccgaagactctgtgaaactgtgcacaacaagcatcttgatctagaaaacataacgactggtcatttagctatggagacattgctgtccctcacttccaaacgagcaggagattggtttaaagaagagctccgacttctgggtggtctggatcatattgtagataaagtaaaagagtgtgtggatcatttaagtagagatgatgaggacgaagagaaactagtagcctcattatggggagcagagagatgtttacgagttttagagagtgtaacagtgcataatccagagaatcaaagctacttgatagcctataaagattcacaactcattatttcatcagctaaagcattacagcattgtgaagacctgattcagcagtacaaccgtgctgagaacagcatctgtgtagcagacagtaaccctctgccttaccagaatgtaactaaccatgtgggcaaagcagtggaggactgcatgagggctataattggagtattgctcaatttaactaatgataatgagtggggcagcacaaagacaggagaacaagaaggactcataggcacagcgatgaactgtgttcttcaggttccaaagtacctacctcaggagcagagatttgatattcgagtgctgggattgggtctactcataaacctggtggagtatagtgcccggaatcgacactgccttgtcaacatgcaaacatcctgttcctttgattcctccttctctagtggagaaggcgatcatagtttaaggctagccggacaagttcatgctgttcaagctttagtgcagctatttctcgaacgagagagagcagcacaattggcagaaagtaaaacagatgaattgattaaagatgctcctaccactcagcatgataagagtggagagtggcaagaaacaagtggagaaatacagtgggtatcaactgaaaagactgatgcccttcagcatgctggcaaacacatggaggattgcatcgtagcctcctacacagccctgcttcttgggtgtctctgccaggaaagtccaatcaatgtaactacagtaagggaatatcttccagaaggagatttctccataatgacagagatgcttaaaaagttcttaagcttcatgaatcttacgtgtgctgttggaacaacaggccagaagtctatctctagagtgattgaatatttggaacattgctag

SEQ ID NO: 1550 - DNA, 99957 bp, Homo sapiens
  misc_feature (18861)..(24451): "n" at positions 18861 thru 24451  can be any base
  misc_feature (32241)..(32940): "n" at positions 32241 thru 32940  can be any base
  misc_feature (36743)..(36979): "n" at positions 36743 thru 36979  can be any base
  misc_feature (51687)..(51706): "n" at positions 51687 thru 51706  can be any base
agaacaatgggctgttgcaggaaaacaagtaacatgtaggaaagacaaatggacccttaggacaacagttggacataggatagtttataacaatgtctgtttaggtgtggtgccaaattctctccagcgacaagagaccatcttccctgcttgcaaaactcccaaggaagggatttatgacaactggaagttatgacaattgagttctttgggggaggatctagttttaggcagacaagggagttcaggaggaaaaaaaagctattctcaaatgtttccagattaaaatatatgttttgtttgtttgagacagggtcttgctttgtcactcaggctggagtgcagtgtaagatcatggctcactgcagtctcgaactcctgggctcaagcgatccccccacctcagcttcctgagttgctgagactacaagtgcataccaccacatctcattgatttttaaatttttgtagagacagagtctcaacatattgcccaggctggtctagagctcctaggctcaagtgatcctcctgcctccgccacccaaagtgctgggattacaagcatgagccaccaggtttccaaataatttttatgttgcagtagcatattctggacgcctttgccatgaacagatacaaatatctgaacatttactttgtacaaagcatgcatgtgtactgttagcaatacgaaatattttagcacaaaaatcaaaggagcgtataacaagttgagagtataagacaaatgaaacttaaaattttttgttttttaatattcatacaacagcaaagaaaccttatatcatgaatgttttttcagctggcaaactggcaaagataaaaacagactgatatggccgggcgtggtgcctcacgcctgtaatcccagcactttgggaggccaaggcgggcggatcacgaggtcacgagatcaagaccatcctgaccaacatggtgaaaccctgtctctactaaaaatacaaaaattagctggacatggtgacgtgcacctgttgtctgagctactccggaggctgagtcaggagaatcacttgaatccgggaggcagaggctgcagtgagccaggatggcaccactgcactccagcctggcagcagagcaagactcggtctccaaaaaaaaaaaaaaaaccatcctggctaacacggtgaaaccccgtctccactaaaaatacaaaaaaaaattagccaggtgtgatggcgggcgcctgtactcgggaggctgaggcaggagaatggcatgaacccaggaggcggagcttgctgtgagcagagatagcgccactgcactcccgcctgggtgaaagagcgagactccgtctcaaaaaaaaaaaaaaaaagactgatatgattatgttgggaggagagaacatattcaaatactgttggctggaatatgaatggttacgaagattttgcagggtggcttggcactttccatccaatctgcatggcttctcttatagtaaatgcatttctaagaattcatttcataaaataaaaacagtctcaaaggatatgtacaaacaccacagcatatttgcaatgcaaaagaaaaaaatggaaataatctaattattcattaacacgaaactggtaagtaaaattaaggtataatcagaaaatggaataactgcttaactactataaagaatgagatgattaaggctgcgcacaacacctcacacctgtaatctcagcactttgggaggcctaggtgggaggatcactttagcccaggagttcgagaccagcctaggcatcatggtgagatcccacctccacacacacaaaaattttttaattagctgggcatggtagcatgcacctctggtcccagctattcaggaggctgagatgggaggattgcttgagcccaggagttggatgctgcagtgagctgtttgcaccacagcaccactgcagcctgggcaacagaacaagaccttccctcaaaaaaaaaaaaaaagaatgaggaaattgaaatttactgacataaaaagaatccccctatatattcagtgaaaataaatttaaagataaggatgtatcgtatgaccccattttaggaaatggggacagaaaaaaagaaagaaggcaacagaaaagaaaattttttctagctctatactttcaacagtggcaatcttggggcacaggtgaagcatgattacagaagactttcattacttcatttctgtattgtttgaaatttcaaccacaaatatgtgtaacttctgttaacagaaaacacacagttctatggtaatacgtagttagggaaactatactagagtttcaccatgtgtattagcatattaaaagttctgagaaggtttgtagtaaagaaatctaatataccaaaagattatcttcaaataatgatgcagcaaagagccaactatgaggcttggaccactgaggagggcttcataggagagagaggaatattcttttttttttttttttttttttgagacagagtcttactctgtcgcccaggctggagtgcaatggtgcaatctcggctcactgcaacctccacctcccaggttcaagtgattctcctgtcttagcctcctgagtacctgggattacaggcgtgccaccacacccggctaatttttgtatttttagtggagatggggtttcaccatgttggtcaggctggtctcgagttcctgacctcgtgatcctcccgcctcggcctcccaaagtgctgggattacaggcgtgagccacagcacctggccaaggatttatactagattttaaagcattctgatgggcaaagaaccagggaaaggaaagtcaaaggcagtactgtccaatatgacgtgtaattttaaactttctagttgccacatttaaaaagtaaaaagaatcctgtgaaatcagttttgtttttttaactgagacaaggtctcaccacgttacccaggctggtctcaagctgctgggctcaagcaatcctcccacagtgctgggattacaggcatgagccaccatgcccggccaaaatcagttttaatatatttctttaatccaatgtatccctaacagtatcatctcactatataaccaatattttaaaagcataatgagatattttacatcttttggtactatcttcaaaatctggtacgtaattcacacttagactagccacagttcaagtcttcaacagccacatgtggtagtggctatctattgtagtggacagtagaggtctaaggattctgaacccaaacctgaatcggatatttaggtgacttaggctgataaaatagtaggaaaggaagcaaagcagaaaaggctgacttggccagagcaggagaccagtccaagatattctggattttctattgtaagcaaataagaaaacagggaaaaatatttaacaaatagggatgatgaccaaagcagtacttcagaaagattaacagtttttgctaaaatatacacgtacaacttcaacatgcaatttttcccccacatttttattacataaaagattataaaatgaaggaagaataatctgtcacccagcgattatatttcattgatttggtatacatttaagatacttctgaacagttaccactgaaatatttttatttcatgacatttttaaatgattcttgaaaaatgcagacattaagagcctcaccaaaatttaacagcctttactttaatattttctaacaagagcttcttttagccaggaatctaaaacattcttatatacaaatttaaaacactcaagaccctatactcttgaaatacattacaaagcattttaattactagtaagaaaactacctacaaatcttaatatacataaaacagtatcaaaactatccaagtcagccagatgtggtggctcacgcctgtaatcccagcactttgggaggctgaggcgggaggatcacgaggtcaggagattgagaccatcctggctaacacggtgaaaccccgtctctactaaaaaatagaaaaaattagctaggcgtggtggcgggctcctgtggtcccagctactcaggaggctgaggcaggagaatggcgtgaacccgggaggcagagcttgcagtgagccaacatgcgccactgcactccagcctgggcgacagagcgagactccgtctcaaaaaaaaaaaaaaaaaaaaacaactatccaagtctcctacagatttctcaccttcaaaattgagagtctatcttctcaacattttgatactttacccaaaggctaaagaaaaaaaaattaatgctcaaaaaaggaggtaagaaagcaggatacgggaagggcaccgcaggcataagccatactcccttgcaaggactgccaaggctggcgtgattcttcagccaaaagtcagaagtccagtgatgtcattaggaccaaaagcattatatgaccttcaatttcggcagctaactgtgctgcaagtcaagatattttctttctttttctttttttaagcagaaaaattatcttaaagttcaccatgttccttctattttttaagataaagaaacgaagattcggattgggttagtgtggcatccgtgattgaataggtactcagtagtaaaaccagtatcagacattatttataaaaaattagaagctgaaacttaatcattccgctgcttctttatggctttttatacttcccaaattacccacaatagatgtattgcctttaaaatttttaaaaagctgcaaaaactgctcactttactgaatacttctggccgggcgcagtggctcatgcctgtaatcccagcactttgggaggccgaggtgggcggatcacgaggtcaggagttcgagatcagcctgaccaacacagcgaaaccccgtctctactaaaaatacaaaaattagccaggcgtggtggctcacgcttgtgaccccaactacttgggaggctgaggcatgagaatcgcttaacccgggaggtagaggttgcagtgagccaagatcacgccactgcactccagcctgggcgacagagtgagactccgtctcaaataaataaataaatactactgaatacttccaaaaacagtctccttgtcctttcttgcctaaggtctcactctgcgggctacctttctcaggaaagccttccaaagtacccgcatcctgaacagcccagcttcccttatcagtcttgtaacattccctggacttcctttttgtagatcttaacataactacaactagataattatttaatgtctatcttctctacccaggccttaagttgaaatttctcaagactggccaggcgcagtggctcacacctgtaatcccagaactttgggaggccaaggcggaaggatcgcctgaggtcaggagttgagaccagcctggcccacgaggcaaaaccctgtctctactaaaaatacaaaaaggagccaggcgtattggcgggcgcctgttaaacccagctactcgggaagctgagccaggataatcacttgaacccaggaggcggaggttgcagtgagcccagatcgcaccactgcactccagcctgggaaacatagcaagactccgtctcaaaaagaaagaaaaaaaattctcaatgctgttttaggctctttgctagaccatacaaggagttctcgatacgaggtctataacctataacctgtaattctataacctataacctatgtcttcctctgccagatatatgcacctgcctgaaatgagaccacaaaagtgaagaacagaaaagacaacctcaattaattatatcatttgagcacttaggtccagccatgtctatttctagacctttcaatatcatgggggttagtggggagaagcttttccctcctttaagctaacttgagttagggctgtcacttgtaagcaagagtcacttgagagagccacccaattcccactgttggaatataaaatctatacagcaatgactcccaaatgcctacctccagcacaaacctctgtcaaaccccagacccatatagacaactgccaagtggaaatccctacttggctgtttcagatatctcaaactccatgtgatccaatactattttcttctacaaaccagctctcccacctcatttttcatatctgtcacccacatctaccctgctttccaagctagaaatccaggagttgttcttgccaatcccattccttctctcatccacgctagttatcgcctcctatccattccaggccctaattatctgccaccatcttaacccatttatgcctgaggctgcaattttttgaatttttgcaatcagaccttggtgatgaccttgagcaggatataaataactcccacgtgcttagcgttccaatagtggaacactaggcataaatgggtttaatccgggctaggccagaaagaccttcctacaagtttgaacatcttcagtcttcctttcttcaaaatgattttccaacatgtaactaatctccctaactgcaaatgtgattataatattttatccctatctctagcatactcctgtcctccttcataagtcaacagccaattatatacagctggatcaagagccaagctccactgttccagactttaacagtataacaaatctgtgccataagaaaggaaggctcatcagaaatataaaactataaaagagtaacaaagtctacaacatcagagtaaataaaagatactcaaagataatttactcatctattcaatgtctactcattagttatatattaaactgcccatacgaactggcttagggaccacaggggccaccctgagatggagtctactgatcatctgatctccctatgcccctaactagtgttcttttcaaaaaacactactggggatttccaggcacatccaagagctttgattagggagagaaacactattcatcaattctaagatgcatccatttttcatattttagcatctccggaattggggtgcaccttacaatcaatggcttcttacaactagaagcatattttaagtggtctgtaacactactgtgtatcttacaatggacataactcaatgcaagtcaacatttaatcttgtgttaaaaagttggtccaacttggtcaatatggaccttgtgatgttaaaaagacatcctaaagcctaaaaactagtaaaaggtgggaaagtagaaaaggaaaagaaatggttcctacttcaaaatttagtgtgataggaaacccattttcctttctctccatggttcgctgctcctaagatccaatagtcagatcaggacagttcaacagctactgttaggctagacaggagcctttccccatttattccttttaatatgcaagaaaagtccgttacagacccaccctgcaaactagtagtgaaactaatatttgtataaaaactgctataaaggccagccacagtgcctcacctgtgtaaccccagcacagggaggctgaggcgagcggatcaactgaggtcaggagtttaagaccagcctggccaacatggcaaaaccccacctctactaaaaatacaaaaattagccaggcgtggtcccagctacctgggaggctgaggcaggagaatcccttgaacccaggaggcagaggttgcaatgagctgagctcacgccattgcactccagcccaggcgacagtgcgagactctgtatcaaaaaaaaaaaaaaaaaaaaaagaaagaaagaaagaaagaaagaaaaaacaataaggtattaaaaaaaaaaaaaaaaaaaaacaggtaaatctgaggcaaataccacagaaaatatttcatttaatggaagacctaggaaacttctgagtggcgaagtggtaagaactgggcttacagattaatttaggcagaaatacataagattagataaaggagaaaagtgaaggcaagaaaatcataacattagtccaggtgggatgagaacttgatttagagttagggggtgggggtggagtcgcggggtggtggggggagaactacgtgaaagccaaataacactagatttgaaaataaattcctgaaaaaaatgtgaaacattaaaattcatatgagaatcagaaaatcgacacaaaccaacagctattaaagaaattgaagtgttactcaaagtcctctccagaaaaaagatctaggcctaaatggtcacataggggaggtcttccaaactttcaaggaacagataatcccagtctaaaatgatcctgaaaaagagaaaaagaaggaaagctgcccaactcgttttatgatttgactactaccttcacaccaatatgaattcagaattgccccacagttagcaagaatagagagcagaagagttacaatatcataaagcagaatcaacagatgttggctacagacaagatatgatgaaatgggaaaaggtttgggtttggtatgacatcaacaaaaataaagaacaccaaagaggcaagtttgctaaggaaaagcagctcagaacaatcaggtacagatatgtagaaagcaactgaataaaaaagaaaaaacaaaacaaacaaacaaaaaaacgtgattcagaagacacataaacaaagaattgagaattattccaacagaaaggtctgaacaatcattctaagggactagagacatagagaaaagtgatctgaaaagtgaaacttggagaacgcatattaaagaggaaagaagaaacagaaggcagaaaagtggcggagaggaacaaagtcagtataatgtcacaaaaggcccctcttcatctagttaatagttaactcttgctcatccttcacaatctgcctgggttccaacaaagcaattttaaggtatctttcccagattctcccaccaccacaagcaccagatcaggtctccatttgaagttcttataatattctgcaccttaattaaaatcacaattatatttaactagagactttatttttcaataagtatttccccactagactttaagctccatgagggaaggatctgttgtatcttactgccttggaccctgtgttagaatacagcgagtatagatgaatgaaacccaaggagaggcatctgaaaatgtgaagtcgatgttaaatcttacagaaaactcaaggagaggacttagaaaaaggtagttaaatgtgttgattaggttatagttccttgtgaaggtgaaatccagataacaaggggttaagaaatgagtggctagccaccaaccaggcaaaggcaggaaaagcagactacacttggcaatctctagagatggattgtgaatgactaaattttaatttcaatgttgcgctagttcgcaattaacaaccatgtgttacttttattacgaacaagctttttaaaatgttaataagatttgaaaaggaaaagcagcaacaagacagcttgaaggagtagcagacttaagaaaaggtttttgtaaactgaaaaaatcttaagaacatttgtactttaaagaacccaaatacgacagagaaaataactcacgctccactaagcaggaaaattagaaggaaaggaaaaaaaccccaaggtgttaactaataagaaagacaaaaaaaaaaaaaaaattctccctctttgacggaaggttaagaagccagtaacagaaggaatttaatgaaggagctcctgctaagtgcctcaacctcttctgtaaagggtggggagaagtgaagaaagtagaaaaagtttaaagtgggctccacggaaaatggaggaaaaattaaacaagaactgagtctggttctactaaaaacgcattctacatttcaatcggcctttcatacactcaccccattcctagatcagagaattgcccatattttagcttcaaatttaaaaatctaaataattctggttcacattctttatttcaacaactgaaaacaatgagacgcattaagttacactctaattcaaagtttaactcctctcacaagtaaatacaataaagtagttgttttcaactccagcaacaaaatagcgataatttcaagtaagagtaactgaaaaatgttcctaaacgtaaaagtgtttgcaaacagttttggttttttttcttcctaattcgtttgccagaatacgatgttcctgggttcaaatcccagctcccttagacaagttagttaacctctttgcgactcggtttcttcccctaaaacaatgaggaatacaataaaccagaatcgttgtaaggattaaatgacgtaacacaggtgccaagttcatactatgtactctgaacagtttgttaaccgcttaaaagagaaaacctgcaggagtttgaccaaattaaaacatctgagagcatgaaagagtaccacgctcaaacgccagaccctaacacacagcatattatttttcttccctgacgcaagctcatttttttttccttgccaaatctttccactaggagtctggaaagagaaaaaagggtccaggcaatccagcagaaagttttccaaaactgaagtacggaatcaccaggccacggagcggaggccgcgcaggacaacaggtgaagcagctccgggagctcgggggccagggccccttcccgcggggactcgggggcgggccggctgctcctctcactcgacccccgcccgaaactcattttgttctcccctgttcctccccacagcgtccggagccaaatcacaaatatcagcctcgccgctccggggcggggaggtgagcgcctttcccatttaaggattccagaagcgtccccggagcgactttcgcccactccgcatccccaaactcggcctgcaacccgcgagtgggagacaaaagaggggccggcgggggacgcggcgcggggtgccgtgggtctctggctgggcggtcccggcccagcgcgcgccgaggcctgcggagctgccggggccgggccgggcagcccctggctccggccaccgcgcgcccagctgcctctgcagcctcgcccgagcccctctggcctccccgctgcggccagcccctccggtccgcacgcgcactcccaactcacccggaccccagggaacgcatcctccagccctcggcgcggagcgggtgggcgcggcgagccgccggggcgaagtggggccccgaatcggccttcgcccttggcgtgcagcggccccgacccggtcgcccctcgatcgggccgtgcgatcttcgccgcgcgcggacggacgcgccgagcctaagccttcctgcccgcccttggccctcctccctcctcgctcctgcctcctcccttctccttcgccaagcccggcaggcggattccaatctctgcagcggccgccgccaccgccgccgactcttgccaggaggggagggggcggcgcgggtgcgggggcctgggggaggggcgggcgtccgcgggccttgcacggcgcgcgcgcactgggaaggcccccgcccgcgccgcgcgcacccgaccacgggcgcctgccccgccccgccccggacacgaaaagagccgagcgcacggcggaagcgcccgaagagttcgcggagcccggcgcccagttgccggggaggagggccagccgccggcaagggggcgccgagctgctggtgcgggcgggagtcggggctgctcctccgcgcgggcccgccggcccctccccacaagccagccccacagctgccgcccgggtagcttcccgcagacgccgtaggtagcacgcgatggaacgcggcggaggggagcgtggacacggctgccgggcgctgcggccatcggcgccctggacgcccgctccggccttcggggccggatatccccactctcgcgggctctttcgcgtggacccctcctccggccgacactcacactgcggtgaacgccagtcagctggcgtgaaataaggtcgctgggaaggcaccaagtcaccaaggtgggggatggccaggtcgtggtagttgcgacaaagaaaaatataagtcacattgcatttgtttctcgcccacccaccgctcccggcgtctcttcccgggctccttgccagcgtgccgaggcgcaggcagggtgatggaggctccccggccgggaggatctgccggggagagcggcttccctcatcgattcgggagcgccaggcccggcgcgcccgggctcctgtgacctgcgagcccgcgaattccagcggcataagataaggagcggcgagggcccaacaggactgaggtcagccagctataaatacgcctccagctccaccgcgggctcacgctggtgacctcgtgtaccctccggaggctcattccgtccatttggaaaatgcaaataattgtcaccacctcttttcttccatttcccctcattcatggtggaaaatgcttttaaaagtattcgatgacccgtatgtgaggaaagaggagataggcccctttttcaccaaatgtgactttaacctccttagtaatccaagaaatgtatcaagtttaagtcacttaacaaaagatgttcttttaaaggtgcattttaaaaaatcacttttaaaactgggtaaactgggtaaaaagaaagggggaaggaaaacaatgtgccaggcatttgtattgacacacattcttgcctgaagaggtgtttagattccagggtattcccttatattctggtgtaaatgtttgaattcccgtgtattttgtttcaattttttggtttatcttttattctgtctcccttttcttcttttacccgcctttgcccttaatgctgcagatagcctctgtcattctgaattatttttcaattctgttttcttccctaatctttttttctgggctcttcagctgtctcaggtttgacagtcatgggttgtagtatcttgctatgcaggaagaagaggatacgtgagattacttgcatcaactaaaattggtcacttttctttctcaagtttccttcataatacccagttttagtttttttgttttttggggtttttttgttcttttttttttgagacggagtctcgctctgtcgcccaggctgaagtgcagtggcgccatctcggctcactgcaagctccgcctcctgggttcacgccattctcctgcctcagcctcctgagcagctgggactacaggcgcccgccaccacgcccggctaactttttgtatttttagtacagacggggtgtcaccgtgttaataggtgttctcgatctcctgacctcgtgatcctcccgcctcggcctcccaaagtgctgggattacaagcgtgagccactgcgcccagccccagctttagttctaaaggaaaagatgggccttttgcttaaggagattcacattgattggtcaaagctctcattgacgtatgctgagcaatgtgtcggcagagaaaaccatggcaagcgtgttattatgctctttatagtctagttggatttttagacatatgaattggtctataaaatagacaacaatctcaggtgggaaccttagtacatcaagtttctgaaatgtacaaatgagtattccctggcttgtgttatctgccactgtagaaatgagagcaaaattgaagcatcaaattttaagtcgtgatatgtttgcttctctgcaaaagactctccttttcaaatcttcaggaatttttcgctctcctttgataaggcccagctagtacccaggcttcaatcctcagcgccctggctaccagcagctagtggggcatgctgttctccctggctactggcatgtttatgcatgccagcccgtttctccggtctgtctgcccagggagacatctggacacgtgtgttctggcccccaaactcaaaagcaacatctcgggatccacagttaacattccgtaatgtgttggtattcctttaagtgggttactagaataggctggaaatggtcttttcttctgtccaggtaggtcacaagagaggtagttgttacatgcccaaagcagcattcattaattacatcgtgcatttagttatttgtttgtggtctgagcccctctgctccactagaatataaactccatgagcaaaagactttgtcagtctctctttttttagagacaggttctcactttgtcacccaggctggagtgcagcggcatagtcatagttcactgtaacctggaactcctgggctcacgtgatcctcccccctcagccgcccaagtagctgggactacaggccagcttgactttgtcaatctattctcaactctctcctcagagcctagtgcctggcaagtgaatatttgttaaatgagagaagagaaataagcatacatatcctctaggcatttctaaaccttgtcaccaagacccttttagtgttagagggtggcatggctatcttggaaagagtgaaggttggctgggaaagctgtggatcacatcctcttcagtgaaatgggacttctgccttcagggatccaaggtgaatagattaatccaagctaatccattcaaagtcattttcatgttgtaaagatcttataaggcaaaaggcagcacgaagtctctgggtctgatgataagttagaggccagtaaggaggcacgagtgaaggaatgtcattggtagggtgaccctttaggttggcttcaaacccaatattaaatgggtaggtgttagggagaataaacagcttcatttttcagcatggacactactacatcttttttttttttttttttttttggttagtagtaccccatcatggcttagaaggactaaactgaaacagaaactgtggttaagaataagatggatgtatataattcagtgcacaaaatagaggaagtttaaaaacctgaattcattttcattgtggtggtacagtgttttacttcttttgtttacttctaaacaacttgctccttctcccttagctccattttaatttatctttgcctcaaagcactggctactatgattgaaagatagatgatggaggatattgctgctctcacttggtcctacctagtccgtggcctctgtattcctcctttccctactatccgtacaccctttaccatagaacctgatctttcctaggccttgaggcaggaagaattatcagagctttggtcccaagctcaagactcagcctcccactgcctcgcccctttctaagaactgacagcccttctcttgtgtctgaaaccctgacctgttagcttgccaggacctggaatttctctgcttgttgtttggacttagctgcatccctgcacccagactgctgggcagttgtaggtattgttggtggcatcacttaattgcctccagctctttgtttctaggctccctgtatctgtattctatctatctgttgggcctcccttcccccattacctcaggctggatgtccccatccccactgcgctcctggactaccacctgttgtttgctcactactctctggctatcaggcactgcctagaggactatggttcctcccaccgagcaccgggagctggggcctccctaccccaactcccacgcagcccacagtagatcttggccttccctgtcctgctgcagctcactgccctgcttttccctatcctcacagcacctggtttattgcacttggattattttttaaccagatgaaaactatatataatatatatgctctggacatacactaagtacatattaaaggtgtattatatgtaattttggctgggcgtggtggcttatgctagtaatcccaagcactttgggaggccaaggtgggtggatcatttgaggtcaggagttcaagaccagcctggccaacatggtgaaaccctgtgtctactaaaaatacaaaaattagctggatgtggcagcaggcacctgtagtcccagctacttgggaggctgaggcaggagaatcgcttgtcgcagtgagcccagatctcgccattgcactccagcccgggcaacagagcgacactctgtttcaaaaaaaaaaaagctatatatatatttttttctggctaaaaattaatccaagtgtaataggggtgtgtgtgtatataatctattgaatataattcaaatagatttctagtctgaactttgtgtgtgtgtgtaggtgtttgtgtacatatgtaagtatatgcatatatgtatatatgtacacacaaatatgcatatgtgtgcatatgcgtatgtgtgcacacatatgtgcgcatatgcgtatgtgcgcacacgtgcgtatatgcgtatgtgcacacatgtgcatatatgcgtatgtgcgcacgcatatgtgcacatgtgtatgcatgcatatgtgtgcatatgtaagtatgcatgtacacatatgtgcatatatgtaagtatacatgtacatatgtttgtatgtatacacacaaaaaacccatacatacattcaaaaatgaaaagacccatgtctgattcttcttactatccctaaacactgattctactcaagaattcctttggagctagtagtccagaaatccagcatgtggagctgaatatgattaccttgggaatgactagtaaaaggaaggcaaggtgcgatgataaaagattcaagctgagataactggggagataaaatctggatcaggagtgcagattcatgaacaccatactgtgcctactgtccatggcttacatggtaattgggatgtattcctagatgtggtgtggtgtcaccagtgtgaccaggcatactagtttacccatcggatatgttgaaagtacctgaccctgtgctggactcaaaagttcagagaatgggaactgtctcattctcactccattgtatccagtgtgctgcttggcacaccagtaggtagtcagtaagtatttattaaatgaatgacatacttaattttgttctctactggtagtttgccctggcgcatttctttttatttctattagccaaggcagggttaggtgttttgttttgttttgtttttccatatttttgaggattaatgataaagcacttatcttgttggaatgagagtctactaacaaatcctgtacatcataataacagaactatcatctaacaacttgttctcaataaataaactttaaaacaacttcctttattatttcaaaggcatacatagtcatatatataaccagtaaccaatacttgtcagtgtttattttaaaatgcagattagtttccatttagtttgctacctaccttaaagcccctcttcctccgatcctgaatgctgctagctctcctcctaattggtcattccctctttcaactaatgttgcccagttgtttagatttctattgtgaaacaccagtcccattaaatctgaaaacactgctatagagtaacatttcgttagactggtctcactactttctgaagaatggaccatattcattctccatttaatgccattctcctccctatactgcctgagtaccacctcttccaagaagtcatctttgactactccatcctcatctccttaggcttttctctcaatggtctacatcactgactttccacatagcttagctgttcttatgtctttctcacaaataagttttcataccttcgttcttcaacataaataggggcctctcagcctgagggagacagtttagggagtaccaaaatacacgtagtatcaaaaaagcagtcccaggccactggagcttaccagttattgaatccttgcttctgcgaatccattgttttgaaggttggtgggtagttgcaaactccttgatgcatctgctgtgctgttgcatcctccctcctgtctatctcccctgcgtatgtaccactgtcgctatggtcacggtactgagcaccagggttgctaggttgcacaactttaagggggtgccattcgcaacctgcctgacacgaatggtgctccctggaattatgcattgcaacatctgcacgtgatcctgtcgaacaccagaaaattctactccagtggcaatggggaggctggtccctggcttgcttaaagaacccgcttttttattgtgtaacattatatacctttcaggacatttgacaagatatatttaagcatttgttaattttgtattattaaatatgtgtgtttataaagaaatagattatcctgaaataaagagaaaacgttggcagtgttctgtggtggcctaatggatggttattattttcttccataagctttatctcccccacaatggacaatgttatacgttactttttttttttttttttttttttttgagagtctgctctgtcgcccaggctggagtgcaattatatgatcttggctcactgcaacctctgcctcccgagttcaagtgattctcctgcctcagcctcctgagtagctgggactacaggtgtgcgccaccacacccagctaatttttgtatttttagtagagacggggtttcaccatgttggccaggctgatcttgaactcctgacctcatgatccgcccgccttggcctctcaaagtgctgagattacaggcgtgagccactgtacccggcccaatgttacttttataatcagaaaagtagatattttcgactgtgggtttcagcaccaaaaaaaaaaaagagtagatattatttaaaagaactggttgattgatagagagaaaaatgaaagtggcaaattgtatatttgtcagaatgaagtcagttagaatcccatataagatatgtaattaaagtttttatttatttgattgacgtgaatatttttcttggtaaaaagagttattctaggccaggcacagtggctcacccctgtaatcctagcactttgggaggccaaggcaggcagatcgcttgagtccaggagttccagaccagccggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggcgtggtggcgggtgcctgtagtcccagctacttgggaggctgaggcaggagaatcgcttgaacccgggaggtggaggttgcagtgagctgagagcacgccactgcactccagcctgggcgacagatccagacaccgtctcaaaaaagaaaaaaaaaaagaaaaaggttatagagcatctcgtccagggcatctttttttttttttaataataataacttaaaacagagcatgatttttaaagctaaaatattagattgtaagagaaattttacaattgcagaaagttcctagaggacatgtgtttactgtcctttgcttgtaggtctgctttatataaagttgaagaaacgtttattgccttatgatagtgaaattatgcataacttaattatctcctcaaccagactatgagctctgtgaggcaaggattgtgcctcatttgcctctgaattcacaataaagtacttagttacttagcatgaggccttgctcaaagtaaaggctcaatgaatgtggaactaaactcaactctgtcttcctcccagtgcttctgatgaatatagtatttccacaaaggaaaggacttcacatcaagtgcctagtggagagaggtattttggggagatgtattttacctatctaaaccttggcttccttacctggtagagttgtgaagttcaatgagaaaagatacataaagtgccaagcactgtgcataagcatagaaggtgcatgcacacacacacgcaaacaataagaaaacttgtttcctttcctctaaagtcacattctggttattaacctacaaactatgacattatcctggtcatttaaatcattccaagcaactaaaaaaggacctggtatctatggctcaggtctgagccactgcctggggcttctgcaacaccccatctttcctcctaaactcgcaacctcatattaccataccattcaacagcttgcttactctttgggttaccttcccattaaacctgggcttatagggataattcaactagaaagtggagagaggtaaccgcttcttaggaggagggagctgcagagccatttccagccttgcctcactcagtaatctgatttcccctcccaattccagggcatgtcttggccctggttccaggaacagtcctggacaaatgttgccaattcctaacatagagcatgaaccagggaatcaggatcccaaaatggctgtgtcttttattctattggcctgagtctagagtagctttaccaagaaactaatgcagcttaaacttcaaggctcctccctcacttccaaagacccccatgggtgctaagagttgctggaatattctaggttgagagggaaagctagtttgcaatcagggaacttttttttttttttttgagatgacgtttcactcttgttgcccatgctgaactgcaatggtgcaatctcaccttactgcaacctctgcctcctgggtccaagcgattctcctgcctcagcctcccaagtagctgggattacaggcatgcaccaccacacctggctaatttttgtattcttagtagagatggggtttcaccatgttggccaggatggtctcgaactcctgacctcaggtgatccacccacctcagcctcccaaagtgctgggattacaggtgtgagccaccacgcccagcccagggaacactgttatgtaagcttttctgataacttgcctaagtaggctttagaagaaagtgacctagagttctgggactccactcatttgttgtgattttgtcctcattctaaatgaatactccatttggtgtttgcagctactgtaacccctttttttcttttctgtctttcttttttctcttttttttttgagacagagtctcactctgtcgcttaggctggagtgtagtggtgcaacctcagctcactgcaacctccgcctcccaggttcgggcaattctcctgcctcagcctcccgagtagctgcaattacaggcgcgtgccaccacgcctggctaatttttgtatttttagtagagacggggtttcaccatgttggtcaggctggtctcgaactcctgacttcatgatccacccaccttggcctcccaaagtgctgggattacaggcgtgagccgccggcgtcctgccagctttttttttttttttttttttaacaaggtctcactctgtcacccaggctagagtgcagtggtgtgatcacagctcactgcagcttccatctcctgggctcaagcgatcctcccaccctggcctgcagaatagctgggaccacagtcgcatgctgccacgcccagctaattttaaattctttttttcttttcttttcctttttttttttttttttttttgaggtggagtctcattctgtcacccaggttggactgtagtagcacgatcttggctcactgcaacctccacctcccaggttcaagcagttctcctatctcagcctcctgagtagctgagattacaggcacacaccactacacttagctaatttttgtatttttcatagagacagggtttcaccatattggtcaggctggtcttgggctcctgacctcaggtgatccacccacctcagcctcccaaatatattctttttcttaaagatggccccacaaaacactggattccaggctgagtcaggcccttctccaatctgtatctacttttctacaatgcttccctctcctgcagctcaccagaaagtcacaagtaggatgagaggggctccgcagggatgtggaggtgaccacatgcaagatagaattgccatcaccactggcattccttctaccccaggcacacattggatgccttgcagtgatccttcttccacaaatgctgggattctcctgcattcccagtgcttctatttgaaatagttttcaggataccctgaattcaggataatacccatcctgaattcagcattggacattgtattagttgagattcttttggttgcaagtgacagcaaccgaatttaaacaagcagaaggaaaaaggcgagaactagactttgaaccagagttagataaagggaataactgatttgcaaatggaaaggtattctgtaagaatttacttaataaaatatttggggttttgaatagaatttgtttgtgaaaaacagcactttgttctcagctaagcaataacaattatggcattctttggttatttcaattatgttttttttttttttttgagatggagttttgctcttgttgcccaggctggagtgcaatggtgcaatctcagctcaccacaacctccgcctcccaggttcaagtgattctcctgcctcagcctcccaagtagctgggattacaggcatgcgccaccacgcccggctaattttgtattttagtagagatggggtttcactatgttggccaggctaatctcgaactcccgacctcaggtgatccaccctcctcggcctcccaaagggctggggttacaggcatgagccaccgagcccgacccaaatggttatttctatgtaaacagacagtttttaaataatgtgaaaatacaggagtgttttggaaataccgaggtgggaacaccggcccgctgtggccaggacgatggcacatcatgagaaggtagcacttgcggttgagaagtgaggctggagagacacagcggcctggcatatgggacttgtaaatgcaggttagtttgggctctgttgagggataatgagaagacatttataagttgtgcaggtccattagatggtcagatttatttttggagagatcctgaatgggaacggattcgggggtggatacggagcaaaatggagacaaggagatcagttaggaagctgctgagatgatgcagaggagagatgttttttaaaggcaggagtcctgaggatgagaggagaaaacaaattcaagacaggttcaggaagtacatgggcagcctgtggtggttatttgttgtcagagcaatatgggagaagacactaggatgatcccagatatttagtttcaatgaccgggtggtgcctacaattcactgaaagaaagaatacaagaggagaagcaggttggctaggaggatggagaactaagtcagtggcagccctggaattcctctatggaagagattcagtcagaaggcatgtggtatttgtcttgaaattatagttacaattataagcattctgcatttatttagcatgcatgttcagaaatgatagcatggatggcggattatttgaaggccttctcaatagaagtttaatcaccttgtttaagcagacaaggatatatgaataacataaatgttttgcattcaaagggaatttaccagccaaataataaactgaagacctcgtctcgcattatattttctaaaggtttgcttagctacttggtggtcaaatatttcagtttatttctgttctactccaaatgacttcatttctagaaaagttgctatatttccttttatatcatttgttttcaaataagtttagggtaaaatcctctcatagcaattttttttttctttttaataatgaagacccttctgagggtactatgtttaacaaaatcaaactcattctttttcgaggtaatctgtttctaggaattactgaaaggtaaaaggaagttttccataacatgtatgatttttagcacctgaatcagaccttgaaagagctgtgcaattacaaatagaaaacacatcttattgttttaatacttcttgaagctatagcatggatgacagaatgtcacatcctgaatttggcattggatgttgtattagttgagattcttttggttgcaagtgacagaaacccaatttaaacgaggtcaagaataaagggaaggccaggtgcggtggctcatgcctgtaatcccagcactttgggaagctgaggtgggtggatcacttgaggtcaggagttcgagattagcctggccaacatggtgaaaccccatctctactaaaaatacaaaaataagccaggtgtggtggtgcatggctgtaatcccagctacttgggaggctgaggcaggagtattgcttgaacccaggaggtggaggttgcattgagccaagatggcgccactgtactccagcctgggtgacagagtgagactctgtctcaaaaaaaaaaaaaaaaaaaaaaaaaaaaagaataaaggggaaattgagcaaaaggaaaagataagtgtggagccttgggaatgacaagatccagaagccatcacactggcagaacactccgtctctctcatttcaactctttgctttccagtgcctgttggcttctttctctcctagagtaaacagactttcttcacacaagagggaacagagggcctgttggactcattcttccagctcagccaccagtaagagaagagaatctctctccaagatctggttttagcagtctcagggaagaagaattctgattgttctggcttggttcacaaacccacttcttgaaccaatcatgcacctaaaggggcagggtctgtatcagaagaaaggatagacgcacatacagatggccaaccatccagcccgtgaagtaggtgggcttgggtggctgtgggacatccacgtgaagcagtgaggcaaaatctggacacatgagcctgaggctcagaggacagcactgaactgaagacattctgtccgatggctcagaaagtcactgattgccttgacaaaattaatggcaggatttattccacaagctcagtagatagattaacacatgatctttattcttagataacccttcatatgtgtgttaatagaggcttaactaggatcagacagtgaagttcatagttataaaataaattgtttttacaagaaagcaggccaggcgcagtggctcatgcctataatcccagcactttggtaggccgaggcgggcagatcacttgaggtcaggagtttgagaccagcctggccaacatggcgaaacactgtcttttctaaaaatacaaaaattagctgggcatggtggtgcacacctgtaattccagatactcaggaggctgaggcactagaatcacttgaacccggaaggcggaggttgcagtgatctgagattgcaccactgcactctagcctgggtgacagagtaagactctgtttcaaaaaaaatttttttaataaaataaataaaaataaataacttttttttgaaaaaaagaatgttggccgggtgcagtggcttactcctgtaatcccagcactctgggaggccaaggcaggtagatttcttgaggtcaggagttgagaccagcgtggccaacatggcgaaacctgtctctactaaaaatacaaaaattagctggatgtggtggcaggcacctgtagttccagctactcaggaggttgaggcaggagaatcgcttgaatgtgggaggtggaggttgcagtgagccaagattgcaccactgcactccagcctggaagacagagtgagactttgtctcaaaaaaaaaagtcaaaaaaaaaaaaagtaaactccacaagagcagaagtttttgtctgctgtactcactgttgtgttgtcagtgtccagagcagtgcctgttcatgtcactagtaggtgctcaataaatatttgttgaaagaatgaatgagcaaataagcaaacaatatttattctgtccacaaatccttaggggggcagaaattatgtacaagttaattataccaaattctaatttttggttcatatttctgggctattagtattttgtgtgtgtgtgtgtgtgtgtgtgtgtgtgtgtgtgagtgtaggagccttttcttctccatcatctatttttaaaattgttatagctttaagaagtactaaaatgatgagatgtgatttctgtttgtaattgcacagctctttcgaagtctgattcaggtgctgaaaatcaaatatggtatgtacaacttccctttactcttcagtaatttctagaaacagaataccttgaaaaagaatgagtttgattttgttaaacatagtaccctcagaagggtcttcattattaaaaagaaaaaaaaattctatgagaggtctttactctgaacttatttgaaaacaaatgatgtaagaggaaatatggcaacttttctagaaatgaagccatttagagcagaatagaaataaattaattggaaatattttaccgccaagtagctaagttaacaaacctttatggaaatataatgcgagatgaggtctttggtttattatttgcctggtaattccctttgtatgcagaacattcgtgttattcacatatccttgtctgtttaaacatggtgattacactgctattgagcatcagggcaagcaagttgtgtttattcccacagaatgttttgttttgtctccaacttttatttgtggccatatagaagtaagctacttctgatgtgacatgaaaaattttacacagaaaaatctgtatttgcacatcctttggggggctttatttttgctaaaaagtagaattcacacaggcaaaaaaaaaaacacatgcaaaatatttttgtgcacacctttaacaggctacattccacttctgaaatgtttccaaaaacaaaacaaaaaatcccaaagccagaatactgagttaaaaagttaacacattataaaagctaggttcctaacacaaacactgcagatataagctgcagatataagtcactccattgcaaaaagttgtgattataatttttttttttttttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtctttttggcaaataggagtccctcagaatctacacttgctctgaaatgtagaaaaattgattcaataaaggacggtggtgaaaccgtcctttgagatattttacttttcttcttaaagagcatacactttttaatgatcgtgtgtgtgtgtgtgtgtgtgtgtgtgtgtgtgtgtgtgtgtgtgtgtaaaccctttaaaaagagattttggaaactgaattctgggaacgttttttttttttttccttcctcaagaccagcccctgataattgaatagatagtttttggagaaaatgacttagagcctgtcagtacagtcagcaacctccttgtccctgcatatttgaactttccaaaaataacagaatgctccaaggtacttgtctgcagctcctgacaaatctccaggcagtcccagcagattttactctgcctgctgctttgtattcaccttctcacagatccaaaggtaggaagggccctgtggcaggagcacatccatgtcccttcctgatgctccctgggggagactggtggcttcgtgcttggaaaaaataggggcttcctgcagctagggacatagctagctgcttccttctccctcatggagaagagacaggtaagatggcagtcccctggaagtctcagtccttagaagaaaagagttctaatacattcccataaaacatttcaaacatgcaaagagaaaaatccaaaacaggagtgaggacagaatagagtgagttggaagagagcctaaatatcgtgctcaagtgagaaacatccacgcaagtgcctgcttcaatgccatgttttcaatgagcatattaacagggcttcctaaaaagggaagcgactacactgtttccaaccacagaatctaagctgccttctttatcaccaaacagctttaagatgcttacctaactcaaactatcactagtataaagtagtttgaaggcccctctacttcaataaatacttaaataatagctagatcaactcagctcatacattttcaaaatattggccaaaacagcaaatgcatatatatcagtgcatctgtcccttccagcagttaacacaattgtacaaactcagtgtgctgcatttaaaggaacatttgaaaaggatgatgcagacctgaaggtgggaggtcctgcctcctcgtgtgttcttactgagggtggcagaaagtaagtttcctcttccccacccagagtttgggcatgtgagcctattctgccatcctgtttcagacactgtctctctgtctctcttcttttccacaggccaccaagcctatttgagatggagggtactgggggagacgtcataagtgagcagtcacaagttggggtgaaattcatgcacacgactggacactcatgctaacgaacccttaaagctaaacaaaggccaaagacaacccaaagcctttaaaaaaatctctcacacaccacagagcaaaactggaaaaacccaactctactttcccatcacaattcaaaaaggagctaagccttctggggatgttggatgtttcagactgagagagggtggctgacagggccatcttttctcagctgtctgcaacctgagccagagcccttcctggagccctggcaattgcccagtggctcccagaagacatctctttggacgtccgggctcccaagaaggttttaagtttgttcaaggtctgaagtctgatgcgcagaggtagctccatgacgctagtaatggaataacacttccttttttggtgaggaaagcccaatgggtcttagctaacaagctctcagctatgactctaaaaataccctgcagcgagtgctgtttggcacttcaatttgtttgccaggggagcgcttaagaactccgcagaatgcttcagattctccacagctgctctaagctctgtcctcctctggtgaccaaagcaagtgtatcgctttgggaaagctgcttgttgcttttcacttttgagttcttggaattctgctctaaatgtctgaagtacaattccagtcttggattaataactagcttggttttgagtcttcatttggctcctagtctgaactatgcaaatgcacgatctgtgtacagaagaaaaaacctaaaattatacttccaaagggctcagtcgcttcctctctctccccattcccctcagaagaaacatcagcctcccgaatcctttgttgccagcagcaggagcagctccgggcctcgtcagcacaggcggccttggccgcctacaagttgatggtgtgtgcgtgcttcttgcacaggggtctgtccttcttggagtagaacggctgcccctccagattcacatggcagacctggagcagagaacagacctgcgtgagacccacgtggcacagggcatgagcagatttcaatcacttttttaagaaaacgccctggccaggcgtggtggctcagtcctgtaatcccagcactttggaaggccaaggcaggcagatcacttgaggtcaggagtccaagaccagcctggccaacatggcgaaactccatctctactaaaaatacaaaaattagccaggggcatgttggcatgtgcctgtaatcccagctactcgggaggttgaggcagaagaatttcttgaacccgggagacagaggttgcagtgagctgtgattgtgccactgcactccagcctgggcaacatagcaagactgtctaaagcaaacaaacaaacaaacaaacagccttgccccatgcattccagagaaaaggcaacagcctatttctcccactatgaattcttaatgacggaagcagagtacatgagttggactatataaaaactaagattcctgaagaacagaataaaatcaaatgaaattaattaaatttaatggaatagagaaaatatacactatgaagctgaccaattcatgctatctaaaatagcatgaatagagtcaatacaagttcacaagtcaatataccacagagaggattcacgtctaaagaaaatcattagtaaactaacaaacacatcagagaagattgtactcactaataattaaagaaaaagcaaattaaaactcccctgactccaggcgcagtagctgatgcctgtaatccctacactttggaaggccaaggcaggaggatcgtttgaggccaggtgtttgagaccagcctgggcaacatagtgagcctctgtctctaccaaaaaaaaaaaaaaagaaaaagaaagaaagaaaagaaaattagttaaaaaaattacaagaaaaactgccctgagataccactagacacatattaatctagcaagacaaataaaacaaaaaaacctcaatggcctgtcacctttaacctaatatgcctgtagccaaaaagcttaaaaaaaaaaaaagtattcaatcaaaaatcagcaatgccaaaaaggaacaaggcctactcgtgcactgctagagacatgtgagtgagctcagtgttccatagggaatctggccatgttgaacaagaaccattgagatgtgactaccctgtaacccagtaatgccacgctagagaattttatcctgcagaagcaactctgcagaacaacaaaacaacctgtgctcaactagaaactgaaaactagtaaaatttctctcaataggaagatgattcagtaaattttcatggtgtatttttccaatggaatgccaccatttaaaaagagagatgggccaggcatggtggctcacgcctgcaatcccagcattttggaatcttcaccacgggtgcaagtaacgctccgccgagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtcacccaggctggagtgcagtggcgcgatctcagctcactgcaacctctgcctcccgggttcaagcaattctcctgcctcagcctccctagtagctgggattacaggcgcccaccaccatactcagctaattttttttgtagtttagtagagacagggtttcaccatgttggccaggctggtttcaaactcctgaccccaagcaatccacctgctttggcctcccaaagtgctgggattacaggcgtgagccaccacgcccagcccaagagatgaaattctatatccccatgatgacaacatatagtctgaggctggaggcatcccagaaagaagagaactaattaatatttgtggggactaccatggaccaagcaggatgccagacactctatatacagcagctcatttaattctcatgaaaaccttataaggtaggtaagcctttctcccacttcacagctgaaaaaactggggctcagagggcccatacgtcttccttaagtcacagacctagtaagttgtaggctgggaatctctgtccatgtctgtaagactccagttctatgctaatttttcccctaccccatagaagaaagggactgtgtttacttgaaattgatctgggttcatgggtttgtacagatgtagccctctgagtttgctggactactagtatgtaagctgggccctgggttggcaatatgccagtaggtcagagtctgccaggaaatcacattggctggcatgggtcccagcttaggagagggcagtgaagatccctgctggggggcagaattgggagccatctccaggacactgacatcaagaggagtgcacgtggagtccccacatacaggtatcccccatggagacagagaaatcacccccttgagttgagcttggggcaatatgcatgtattcagtccaagagagttggagaggaaaagggcaccacgctagccccatgtgcaaggctctgatggtccagttggggacgttatacctaggatcacacagggcttccaattgggttctgggagccaatgagctgcaaaagtgtttgaaaacatcccaggtggatgcagtgatgctgagtataaccaggctcgtgtggaggcctcaagctgctggtgacaatttaaagactatgcaaaaagatggacatccaagatctaactggtgagaatgggctttagggaagacagaaaggcatctctggaatgagtcagcctgtcaatgactgcagctgtgggtgggagaccatacctggactgggacaatgctggttgcttgtgagaactttgggatgagtcaggctggggagagaaggtgtccagggactgaagaccaacaaatgagaaagggacagaacctcaaagatggctcataggtgagatggggctgagggtgggaaccctcataaggagttgtgcccagtgtcttcttggtgcaaggtggcttcatagtggaggaggccttctgcccacccagcacagggggcaacagggatggtccaacccccaggctctgtggctgggtgacatcagggcctggctataaaagggtagcgaccatggacagtgctgactgcaagtcccagcagagttagggtaataaactaggccagctgcagcagcccctaggtctgcctacaaaagttatattactgcccatcccctcctgatacccacaccagtggggaagggcaagacttagagcaaaagagggatgggtaagacatttttcctccactaaggtcggaccctttccattggaactcaagtgtcgacgccagacagaagcttaactttcaccctgacccacagtgcacttctcaggctcccagccttcactttatatgctttggacttgagggatactgtcctgttctacttttgaattgctcacatctgttgctttgttcacctttcaagattctagattccgtcagggtagagacttgttctggaacactcttgtactgcccaaatgccaggaatatttggtaaactgagttagtctaaagaatgtgctatcctgagatctcactggttagaaaacagcacatcagctgggagagctaccccagatctttctcttactaattttttggaagttacaggaaaatacatgctcatcaaaagtgatttggaaatatgaagtgatagaaagaggaccaaaaaaaaaaaaatccctcaagtccctcaaagttttccaatcaaaagatttcttcctaatgttaagaccatgttccggctgggtgtggtggctcacacctgtaatcccagcactttgggaggccgaggtgggtggctcatgaggtcaggagttcaagaccagcctggccaagatggtgaaaccccgtctctactaaaaatacaaaaattagccaggtgtggtggcaggcgcctataatcccagctactcaggagcctgaggcagagaattgcttgaacctgggaggtggaggttgcagtgagccaagatcgcaccactgcactccagcctggcgacagagcaagactttgtctcaaaaaaaaaaaaaaacaaaagaaccatgttccactttgctatatgttgacagagcagtgagtatcatgcaggctggtttggagggagacctaacgatctccatgttgatcctctaaagggcagtgctatgggcctctcacaggctggacttcactctctggaacttatttgtaatatcagccttagccaccccaagctttacgccttcttctggtctctctcttggacttttgctgttgtgactcagctgaaattgcgaggcttgcagaagcagacccacactcacctttgccacgattccctctgcatgtgacacagacctctcatcagcctgcccatggaaaacaggccttctgtgccactgtcttcctggaccttccccaagtctcttggatccttccagaagttgggtaaccagatgtgcaggcagtgcctcaggactagacaagccatggcttgaatgtaaggttcagagacccctgtgctgtgcctgacacaggggagctatgactctgcaggggacaaacccaaagccagtatacttacaccattgtctctttttggaggggatgtatttaaaacaccctaaaagacaactagagaatctgttcaaagagctagaaaatcagagtgttaaggggttgaattgtattccacaaaattcacgtgcaagaaggcagagtttgccgtgagctgtgatcacgccattgcaccccagcctgggcaacaagagggaaactccatctcaaaaaaaaaataaaaaaaaaaaggagacccacacagagacagacacactcagaggagaatgtcatgtgaagacacacacagaggggagacaggcttgtgacaatggaggcagggattggagttacacagctgcaagccaagaaatgccaaggattgctagcaaccgctagtagctcggagagagactatggcctcctgtcagcaccttgatttaggacttctggcctcctgaactgtgaaagcattcatttctgttgtttgagccatcagtttgcagtaatttgtcaagacagccctagcaaaccgacacacagagtgaatacagtgtgtcccacagatggcggggtatggaagcgaagtgtggaaccaaaagtatatggccgtaaactttatgactagggtcatcctatgtcagaagtctataaaaattattcaagtaaaaactgtacagatatttcatacatttccaaaatttaccttgagacactctggttaaaaaaaaaatagtagaggtgtcttaattttcccaaatcagccaggcgtggtggctcacgcctgtattcccacaacttggggaggccaaggtgggtgaatcacctgaggtcaggagtttgagaccagtctggccaacatggtgaaatcccctctctactaaaaatacacaaaattagccaggcatggtggcatgtgcctgtagtcccagctactcaggaggctaaagcagaagaatcgcttgaacccaggaggcagaggttgcaatgaaccgagatcatgccactgtactccagcctgggcaacaagagcagaaactctatctcaaaaaaaaaaaaaaaaaaattctcaaatcgagattaggcaatgacagattgacattagggggctttctcagggatgactgtttcctacctctccttcagagtctaaatgtctgtaggctcaccatcatgtgcccaccccaacccaaaaccctcagaaggaaaatgccagtctcatactaaaagtgacccggctgttcagcagaaataagtagcacacagttaatagttaatccagggcttatctcctggcagctatatatcaggaaaggaccacttaggaaaataaaatggtactcagtcttgctttccaaaggtgctaccaagagaaaccctatctcagcttttcataggattagtcagctccaatctagtgtttggggtaacaatttggaggggaaaaccttcaagtcactccatcatatctgaagtgacatataaccatgggaagccaactgcccctctcaaagccaagcatcatctgctgcttttgcccgctgacaacactgctggtgagacaagccgctggtttgccaaaccctgggacactctgttgtccttaacgaaatggaaagtaacaaagccacattggtttataaataattattaggaatgaaactttgttcgactgtgatgtatcgaggcatcatggtgtttgccagcttttaaaaatgatcaggatgtcagaaagctgcgtggcaaggtatgtagaggttggtcatctggctcccacttcctccctcctgcctcttctcagaaagccagagccccaagctagagacatactgcgcaaatgaagcaggtgtcgtgccaagtgtggcccagggcttcgataaacttgtcgccagcctccacggggaaatcgcagccatggcacttggtgctgaacagattgatgtagtctgaaatgaaaagcagagtgaagaccccgcacccagtgggggcagcggggacccaaagccaagacaaaccccaaatcagtgggcagaagcagggggtgaaatctaattggttgtttgtcatctcacagatgaaatactcagttacatgactgatagttttccattttccaatcattgcattgatgttgttcagacccaggcttagacaccatcttgtgctggtttgatttgcaaacactttctggaattgtcatcaaccttctgcagggagattgtctcctctgcttctgtcacctctaatagaccaaacggatcaagccccaaagagaaaacaatccacatttccaaacatctatgcttagtttggaagaatgtgggtccaacgtatttaagagttatagaattttctttgcttggccattcttctgtcatggggcatttgtgttgacaacaagtttttactactataaacagtatttgaactactttattggggcatgtcctcctcctccttccctacccccaaccaaggagataatgctattaaatattattgatatgatgctttgcaatttaccaagcattttcacatggatggtgttatttacaagtatgtcaatgtcagggactacatcttagctttctttgcactcccagcacaatgcctgacacacagtcaatatccaaaacatatatagggaatgaatgcattaaccaatcaatcagttcatcaatgaatgaaactgatcatcacaaaatccctcagaaattgaactattattatctttttgttttgttttgtggatgagaaaattgagactcaaagaggtgaagggcccagccagcatcccacagctgaagcacagtgggtcaggttctgtgctccttcaccagggcagctgtcctctctaggcccaaaggggctacagttctaccacactgactgtagaacatctctagattattctagaaaagctccatcccgtttacaaagccttcatccctcctgagaagtgtacgcattcctccataactcttccacagttggctttttcttaagtgatttcctgttcttcttgtggatagtatgtccattcattgtcttagaccacgtcttactgagtgccagtgtgccatgggggttacaaaattggactctgaataaaggaagagctgggttcaaatcccaactctattaagaaatgttcaaacctggggcaagtggcgtaacttctcaaggcctcaaccttctcatctatataatgggaataattattgtaccgaactcatggggttttgagtggattaaataagataatgtaagtgaagtatttggcacaaacactcaaaaatgttggctcttattttgaaagtcttcataactgatgcaaagagggaaaggaacaatgatttgagtgccattatgcctcctgtttaatcctcatgacatctctgtgaagagataatattccctatttatttatctatttattttatttatttatttatttattttttatttttatttttttttgcgacggagtctcactctgtcaccaggatggagtgcagtggcatgatgtcggctcactgcaacctccgcctcctgggttcaagcaattctcctgcctcagcctcccaagtagctgggagggcaggcacgcgccaccacacccagctatatttttttatttttagtagagatggggcttcaccatgttggccaggatggtctcgatctcttgaccctgtgatccacctgcctctgcctcccaaagttctgggattacaggcgtgagccaccgcgcccagcctatttattttttgaggtggactctcactctgtcacccaggtggagtgcagtggcacaatctcagctcactgcaacctctgcctcccagggttcaagcagttctcccacctcagcctcccaagtagctgggattgcaggcatgtgccaccacgcctggctaatttttgtattttcagtagagacggggtttcaccattttggccaggctggtcttgaactcctgacctcaagtgatccacctgcctcggcctcccaaagtgctgggattacaggcatgagccaccgcgcccagcctagtattccaattttaaaggggaggaaactgactggagaggttccatcacagaagtcataaggagtagccccagtcctgatggactccaatgttcatcctccttctatggctttacgctgtctccagctccttatcagcatggcattgagctttgatcagttacacttatctcttgcatgtgttttccaatatatagcttccccttttgtgcttaattgtagcttgtcatgcaaatgctcttatgtatcccagtccatcaatcttctctgatggaacacttaatttctttagtaggcagaaatgcattgccttgccagagctaagaaaacatcgttctgcttcctttagaaagttaccgcccaggttgcagttcactctgtgctctgcaagaacttactactatctggtatgggctgacccgtctccacctgaggacaagccctgcacccacttacgacttctttctcatcactcccaggtggtctcatggtgccctggactttctcttacacctccatgcctctgtgcaaaccaggccctgggcttgaaaaaccatccccactttctgtacctgagagaatctctgcaatcctttgtgctaggctgtccttcagggaagtcttcatgccctacataccccaaccaagagtgatgagatggccttgctgaaggctttccctggccttccctcctccatttatccatgcatcctatccattcatccatcatctccttttttttttttttttttttttttttagattggagtcttgctctgtcacacaggatggagtgcaatgatgtggtcacagttcactgcaacctcaacttcctgggctcaaaccatcctcccacctcaggctcctgagcagctgggaccacaggtgtgcaccaccacggtcggctactttaacttttttttgttttagcagcatggggtctccctatattgtccaagctgttcttgtaactcctgggctccaaggggtcctcctgccttggcctcctaaagtgctatgattatcaggcgtgagccaccaagctgggctgtgttccatactcttacaataaactataaaaattaaattaaatggttcaaacaacctaatgtaaatagtgcattgccttctgcttactggcttattcacagactaagctattaaagtgggcctgaattggccaggtgcggtggctcacgcctgtaatcccagcactttgggaggtcgaggcaggtagatcacgaggtcaggagttcaagaccagcctggccaagatggtgaaatcccccatctctactaataatataaaaattagccaggcgtgttggtgggagcctgtaatcccagctacttgggaggctgagacagagaattgcttgaacccagaaggcggaggttgcagtgagtcaagatagcatgccactgtactccagcctgggtgacagagcaagactctgtctcaaaaaaaaaaaaaaaaaaaaaaaaggccaggcacggtggctcacgcctgtaatcccagcactttgggaggccaaggtgggcggatcacgagatcaggagatcgagaccatcctggctaacatggtgaaaccctgtctctaccaaaaatacaaaaaattagctgggtgcagtggtgggagcctgtagtcccagctacttgggaggctgaggcaggagaattgcatgaaccccagaggcggagcttgcagtgagccaagatcgcgccactgcactccagcctgggcaacagagcgagactccgtccagcccgtggtgaagacaaaacaaaacaaaggcttgaatttacctctggaatgccttgtcttgcccactgattcatttttctgttttaaatttgattccatatgatttggagaattatcgctttgttttaaaatttggtagcatgggtctgatactaacacatttttgtttaagttggtatttttcttcacaacttctgcaaaagttatttctgcaaaaggagaacattgctggtaccgaacaaagtctgtgcatgggccttttccacaaggagtataatctagctcttcatatatttattccttcctttatttctccctttaagtctttctaattttctttgactctctcttgtcccaagctgaattactaccctcacatttaatggattttattgctattgtaaaaggatttctgtccatcaaattgcaggtgctctgtgttgaaaaggggcttggtacttttctagagcaatggttcccaaacatcagaagcacatggagggtttgttgaaacacagcgtgccaggctcccctccagagtttctgattcaccagatctggggtggggcctgaagatctgcatttctaacaagttctcaggtgatgttgctgctggtgttgggaccacactttgagaaacacttctgattcccacacctaactgaaacacctgggtagggtggggcaccctacgaaatgctgcttctgtgggtctgaggtaggtctgaaacaatctattttctctctagtttgttaagttccctaggtgaccatgatgccaggtttgggaactgctcgggtgcaggttcatctgtgaagggctgacccacctatctctcttctttatatgcagatgtcagcttatctttgcagccagctgaagcatttttcagcctagaccctatcattctggctcaatctgcagatttgacaggactcccttctgtgtcttcttccaaattgttgattaaaatgacgagacgtaaaaatgaagtttcacctcatacccgttaggatagctactattttttaaaaaacagaaaataacaagtgtttgcaaggctgcggagaaattggaacctttattctctgttaatgggtttgtaacacagtgcagccgttatggaaaacagtatgaggttccttacaaaatcaaaaatagaacagaatcaaaaataggcacggtggctcatgcctgtaatcccagcacttcaggaggccaaggcaggaggattgcttgagccctggatttcaagaccagcctgggcaacatagcaagacctcatctctacaaaaaatgatgaaaattagctaggcatggtagcggatgtctaaagttccatctacaggctgaggtgggaggatcaactgggtctctccagttacctaggtctgaaggtaaatctgcttcctcactgtcttctcttaacactagaccgtcttcttcctggatcttcttactcaaaacatcatttttgagaatcttttcgggggagttgctatgatgaggggcagcagtgataatggaaatctatcattctttcaaaagcctcagacacaaattgcggcttatctcaaataatagaagttataatgcttttagtagaagaataacagcaagttgtataagcataacagctctttctttaactaccgatcaatatcatatgctcatgagaaaggaaaggtctggtattatcttctcccttttacagatatagaaactgaggcacagagtaactaagtgacttgtttcaggtcattcagttaacttcagagctgggaagggcattcactagtacaagaacccaagacgtttcttttctttctttctttttttttttcagatggagtcttactgtgtcgcccaggctggagtgcaacggcagtatctcagctcactgcaacctctgcctcccgggttcaagcgattcttccacctcagcctcccgagtagctgggattacagacgcccgccatcatgctcggctaattttcgtatttttgtagagatggggtttcaccattttggccaggctggtcttgaactcctgacctcaggtgattcgcctgccttggcctctcaaagtgctgggattacaggcgtgagccaccgcgcccagccaaaacgtttattttctaatttacagtcaggggaaagaagttttattttgttttgctttttcccttgaggaactgaatgttttctcctttctgattttaaagtaaactaacttactgtgtttctctttttgccctcaaatttgctacccagttagtccctgcagctctgttattcttcataatcagcatgcctgcttttcccgcctctgattttctggttctactgtcttagccttcatgtctgtgttaccttttctggaacctgcttcaaatcctttctgaagggggaagcctctgaataaatgagtgactgacttccacctatctaatgaagtgctttgtctcttgaatttacaataatttacttagcattttaagataacatatagcattttgggggtacagagaaactctgaattcactccgtgagattacaggaatctgcaggaacatcaaagtctgataaatatcacaggggcagaggaaggggtctcgcatatttgatgctctacacgccttctctggtttaatcctcaccacagctctgtaaggcaggtgtttacagacgaggaaagtaaggctcagagaaggttagtaacttgctcaggtttacaaagcagcccaaagtggaaccaggaatagaatgaaggacaaagtccacagccaaggccttttcagactagaccttgtggtctccaaatcaaaataacctgaaaggtttcccagtggtcataagatgccaacttgtgatctacatttttttttttttttgagatacaggatcttactctgttgcctaggctgaatacagtggtgctatcacaggttactgcagcctcgaactcctggactcaagcgaccctcccacttcagcctcctgcgtagctgagactacaggcacgcgccaccacacctggctaatgtttatattttttgtagagactgggtcttgctatgttgctggtgtcaaactcctgggctcaagcaattcttctgtctcggcctcccaaagtgctgggattaaggtgtgagccacctcacctaaccagatccacatatttgatgcataaaataagctatagactctgcacctcactctccccaaagctgcaaccatatgggcaggggagatagttaacttcctttgtgtgatattagcatgattctgccattaaaagcaaaaacaaaggtttcttccagaaataaaggcctctgggtggtcggatgtgaatggattaggcaggagttagttccctgtgcctgcccctttctcccaggctgtggggcctccccacatgccatcgaagtgttcctacctttctcgcagtagggctccccgtcttccatgtggaagaggctgttcccaaaaggcttcttgcaggccgcacagacgaagcaggtggtgtgccatgtctgtctcaaggcatgcattacttcctgggggaaagagcctaagctcaggacagaaaggagagagggagcgggcttgactaccccaccaggctccagccactgcccgagcatcctaccagggaacagggcaggagatctcaggatgcaggccttggtcactctgaagaaagacccaggggtgtcagagaaggggttgtcactctccagctgggtgccaggttctgtgctttcttacataaactgtgaggcttaatcctcccattaaacctgggaggaggtactgcttattactgtcatttaccaaaggggcattgagggttaaggccacattctggtgagtggtaaggtcaggctgtgaagcaaccacttgctttgcagaagttccaccaccacttcaagctgtgtggaacaggcacacaatcatctcttgcatcaagttcatttatccccaagtttattggtggcaaaccaattcccttttaggataaaaatggagttgctttctctgttaccagcaacttcttggcttcctaatgggatcccacgatcttggggaagggctggggaagagacatgggtcagaggaaatggaggcctcccacttacccccataattttggtgttgcacttggcacacagcggggcaaagaattgctcataacatcgctcacagtaaacgttgttctgctcttccacaaagcacacatctgccagggaagtcttgcagtaggcacaggtgaactcttcagggtgccaagaacggcccatggctaccagaaatgggcccctggggaagcacagaatggcacccagtaaggcagctcccagaacttggaattagatatttgaagaaccccaacactgtttatacttttacccaataactctgacttttgtgactgttctgatgaagtaatgtgaaattcagagaaagctccatgcagaaaggtgttcattgttgcatcacttacaataaagaaaatcaggaagcaactcaaacatctaccaataggggactgggtaaacatattatagaattcagttgaccactgataatgatagtaagaaatgcaataatgatgatgctgatggctaacatttattaagtgattactctgtgtcaggctctattcaagaagacttttgcatttattaacttgcttaattctcacaacaatcctacgcactaggtactattataatacccatttttagataggggaattgaggcacacagagtttgaacaacttgtttaaggccatagggctagtaagtggtagaccaggatacaaacttgtattgtctagttccaggttagcagtcagaacagtgggactatgaagacatttttttatattctaatttttacttttctgtgttttccaattcttcactaatgagtatgtattactttagttttaaataaaagtgtatttttcacgtatataagctcacaccacacatgcacacaaacatactgtattcaaacaacagcacccatggtccatggcttctaagtatgaaatcacttgttttcattttagtctggcagatgcccaccaaccccctgagcagcccaggcctgtctgtggaaagacccagaagcaaccctaaaggaaaactgggtcaaaaccaacactgtctaacaaaatgccccgtaaacctactgacaagcctggtgattcccagacctcaaccttagcccaagggggagttcctggcaccaggtatcctgctggagcttcacccacatacctcatgccattcctcccagctccctgggagagtgggtgtcacacaggtatggcagctaaggctcagagaggtaagaccagatggcaagccagaaggacccgaggctttctccctacacctgcctcctacccccatctctcccaaccagggctcagactgtgggcaagcaccccacacacacgcccttccagtgccccagtgcaggggcacagctggaccataccggatgacattgttgcagtgaccgcagagtggagtccggctgctggctgggaatcgctcagccctctggacggtccccctggcaagtggtggcacctgaggacccgctggggtgtaggctgggcctccccggggcagggtctgcttgctgatggaggtggtgctcttgcccggggcaaacttctgggagaagctatcatctgtcacccaaggtggacggctggcaggctccgcaaggcccccgctgtaggccaccgagggtgcagggttatagttgggggcaggtgagggggtataggctggtgctggggatggagnnnnnnnnnnnnnnnnnnnnaaacgagctgataggaagccagagagcaggaacccgaactattatggagaagtggtgtcacccctggtcaacaaccagggtacacgatcaggcacaccctgaatgacgtaccgtcctcacacagggcgacggaaccgggcaaaggcgacaccagacggagagacttgctccaaggaccgcaagaaggagacccgacaacgcgtgggaatcggccaggcctgtggagaggcccccggacaagtgtatgcacctaagcacccgctggagtgaaggttgggcctcacgcagggcagggtcatgcattgatgatgcagggtggtgctctttgcccgggggcaaagcattcggggaggagagctgatccgatcatgtacaccgcagggtgacggctggcaggctccgcagggcccccgctgtaggccaccggagggtgcagggttatagttgggggcagagtagcggggtataggctggtgctggggatggagtgtaggtggggacaggtgagggggtgtaggcaggggcaggggaggggtgtaggcaggggcaggggagggggtgtagggagtgggactgtaattggcccctggggacgggctgtaggtagatgcaggcactgcaaaagccaaaaaaaacccaaagaaaggtgtgtcaggaattcattcttcccagttcccctcactcctagccagagaaatgcaaaaggtgactttaacattagagcagtacaatttcagtttttttgggagacttgttcctgaacttcttgatggcccagatttgaattctcagcagggtgttcacagagctagggagcaagcacagcagaaccctcgacagggctggaaaagggacatggctataaatatttgcagctgtgcagggtggggctccgccaggccttgactgcccaaggcctgcataagacgcagagtgggggtgggggtacctgggcggggagaggtgggagtgggtcacctcgcctttgactgcaagatgctttcagttgcactctgaccagtgatttgacatctgaaatacctcccttggcataagtttgctgaacctggacctaggtcagccctcaggacaaaacaggtgacctggtagctgggttttcaggttcaggtttcaggtttagctacaattactttcttgaaaaacagcttggcttgatttgtattggggggcaattccgtcttggtttgattagggtgggggatcttgaaggagtcattcagagggtgctgggcagagactctagggtgacacagcctagaagtagctgctcacttggcccgtggctgccttgggggacccctgtactcccacatcgctttggtggaagctgagagtgtgtctgagtgactgtctaaagattgcccaggcagtcagagcacagggaagagaatgcaccacctcacttctatcaccccctcctccagctccctgagagcagaaaaacgttttgggctcacagcacagaaaaagcattgccactgcttacccacagccctctcccgcctgggccctcaacacctagccagggcagacccagctgcaccctgcaggcaaggtccagctggcttcctcttccagtgagtgaggttccagaagcctcaccacatttcagtctgctcctcagcaaagaggcctcattcccccaaccctaggaagcatgtcagcacagcctccctccccattcctgagctcagtatgggcaggatggactgcattgaggcagtccctgcacccacaccccgcctctgccccccaccccatactccagcctcaacctggagaggaaggttttccttagggcctaagaccctggccccatctccagtctctctttcccacctggttcccctggaccgcctggggcagcctgtggctcccactctgcaccttccactcccaggtgacccacccttcagagctgggtgagctggaaatccctgtgctgggggtgagtagggaccaggtagataggatccatccatgttgttgaaggaagaagagataaaaccctccacagccctgccctggagccatcctgccagtgaggccttcaaaagataataccggttgggcatggtggctcacgcctgtaatcccagcactttgggaggctgaggtgggcagatcatgaggtcaggagatcgagaccatcctggctaatgtggtgaaaccccatctctactaaaaaaatacaaaaaattagctgggtgtggtggcgggtgcctgtagtcccagctactcaggaggctgaggcaggagaatggcgtgaacccaggaggcggagcttgcagtgacccgagatcgtaccactgcactccagcctgggcaacagagcaagactccatctcaaaaaaaaaaaaaaaaaaaagataataccttctccataaggaatcttcctcccctttaggggtaacgaggcacatagcatctgtcatctgaatcggtcttcacattattccctctttacacttgaggtcactgaggctcagacagagctagtaagtgggaatacatctccaaatccattcattctatcatcccaagctgcctctgtaaagaatatgagtccaatttctagaaaatctcagtgcaacatgtcagggaggagtcattttcaacatgaaggagaccccctgctgtggagtcttgatagcatagccaagagccctggctgcaggatccagctctactacctcctggttttgtgtccttgggcaagttccttaacctctctgggcctcaatttcttcatctaaaactggcaatactgattcttagtatctcacaaggttattatgaggattaagggaaggtaagaaatataaagagcgtagcctagtacctggcatagtgtgtcactaaatgtgagtgaggatggcaaggatgggggcaacctgggtgtcagggtcagatgtactgtcagcctgtctcatggcctgctgctcacctagggaagcccagcccagttagactggtagcgcctagggttgggggagaggagggaagggaaatggaacatcctgaagtcagataacctgagactgaggtctattcagtggtggtggaatgcctgacaccctgcctgccccacagggcatgctggggacctgctggggtgacatagtgaatggattttgtaaatgtgtacagcccaaatttgaggtattgtcaccctccctaacaactttgcagagaatatcaaaatgctgggggaagaagtgattccaggaacaccaccagggacagagagcagggagaggtgatctagcacaacttcagagcagcttcatccctctgttatatataagggggttctgtgcaacattttctttcctttctttgtgaagtgcaattctctgctaaaaaagattaagattggctgggcgcggtggctcacgcctgtaatcccagcactttggaagactgaggccggtggatcacttgaggttaggagttcgagatcagcctggccaacatggtgaaaccccgtctctactaaaacttctagtagccgggcatggtggtgggcgccttgtaaacccagctactcgggaggctaaggcaggagaatctcttgaacccgggaggtggaggttgcagtgagtcgaagtcgtgccattgtactccagcctgggcaacaaaagagaaactccatctcaaaaaataaaaagattaagaccagaagccctaatcctgcggtgtccaatacatagtgctacgtggccgatgagcagctgaaatgtggctagtccgaccaagaagtgccgttagtgtaaaacacacaccagattttgaaggcacattaataattattttatattgattatatgttgaaattatatatatatatatatatttttgagacggagccttgctctgtcgcccaagttggagtgcagtggcgcaatctcggcttcacagccacctctgcctcctgggttcaagtgattctcctgccatagcctcccgagtagctgggactacaggcgcccgccaccacgcccggctaattttttgtacttttttagtagagacggggtttcaccgtgttaccctggtggtctcgatcttctgaccttatgatccgcccgcctcggcctcccaaagtgctgggattactggcgtgagccactgcgtccggcctgatatcttaaatatatgtagtcaaagaaaatatattaaaatgaatttaacttgctttcttttattttttaaaaatgtggctaataggaaatttctattgcgtggtgctgccttcaccaaaatgactgcttccacatgccaggccctttacgtgccttattactcgctgcaatccaaggaggcagataatatttgcaagtccattttacagatgaggaactgagacttggagagcttaaatggctgcctccaagtcatccagctggtgaactgcttagccgaaacgagctcaggctgccagactcaacagcagatgcccgcttagaaactccccaagcagcaaaacaggctttagtacgccccctttcaagtaaacagggccctggcccacctttcctgcctccctccagcaatactaaccctattccccctgcctggcagtcgcttccctccatcggaaggccttacagactcccggatccacctccttttcttttccagcccccacaacacagaggtctcacagaggcaggctagaatctggaccccgatttgacggcttccttgcttggggctaacccacccagagaaggaacctccccggcctcggtggcccggcccggcagctccgttcccccgtcgcaaccccgactccgtcggggggcgagcaggcagtggcgcttcgcagccctcagcttctgcatccttcagcctggctcgccgtcacgccaggagagacctgatatcccatctcgcagccccggggctgttgctatttttgcgtgacggaattaagccagtctaaattagaaggtgatatttcatctctaattggcaagttcaaaagtcccctatcgcactcggcgggctcggggatatgtaattaaacaaggtgatttctgactcacgccgggccgggcccggctctccgcaagcgcctggccgccgcccggcccgcgggccaacgtgaccgtccccggcccgcgcgcagggtctccgcgccgccgccgcccgccccctcccgggcctcaggtgttccggggagcggccgcccacctcgggcgccagcgataagatccggcctgcgaacgccgccctcggcccggaggaggccccggggggagctgcggctgcggccgcggcgctccgggtcccgcgcgggctccccgccctctctgacgcccggatccgaagagcctggagggaaggggagcggaggggggctcgggaccacacgccccacttcatacggggccgcctgccagccgcccccggactccgcttggcagccgggcctcccggagagggaggtggaggcaggccgactccagcgcgcgcccgcccggccgcctctttccccctaggcaggaatgagttaatgtctgcgcggcctgggaacggcgcgggggcccgcggctccggcccgtctcgctcgcctgggccccagcccgggaaggaggaggaaggagacgcagggcgggctggccgcgcgcccccggagccctgacgccgcctggcgggctgggcgaagacagccggaggccgccccggaaggtgccagaagcgcctccccaggaagagacggaaatgtcctccttgtgccccggcaaggcctcgcctccacccgccgcttctcctccaactcctctccagcctcccctccctgtgttcccagtctctgcaggggcagcctcttcccactgctccatctaaggcttttcactactgcaaaatgccacctcgccctgcggagttttcacctcagaaccgtctatccttgccccttctctgtagggacagagaagggcacctcccgtgtgacagacgctgtgctgggtgcttcattccatccccagaacacaaggtgtccatgaacagcgcagcctggatggatgaggcactttgccttcgagagcagagcaggccgtggcaccggcctctgtctcgggcaaaagccgcttcgaccgcccacactcagccctgctgtcagagcgagcttcatgaaccagcgccccgaagcaaggcctgccctgactcagtgcctgtctcatctccctgggctccagcggcagagaaaacttccctggggtttctccctgcgcctggataggacctgctcccgagtctaggctccttatgtgctgttctgtacccccatggctgcggccaaatctcgcacactggcatgacacagagaagatggagtctcattctgtcgcccaggctggagtgcaatggtgcagtctcggctcactgcaacctcggcctcccggcgattctcctgcctcagcctcccgagtagctgggattacaggtgggtgccaccacgcccggctaatttttgaatctttagtagagatggggtttcgccatgttggccccggcggtctcaaactcccgacctcaggcgatcctcctgccccagcctcccaaagtgctgggattccaagtgtgagccaccatgcccggtccggagaagacttctctgctctccttcgctctcccttagaatcatccaccgctttcttgctcacctgtctcccccagaccagatgcaggctccataggattctgacccacagctaggggacggagggcggagcatcattagcaaggccttgcttcccattcttctggggatgtgcccccagagccacttcttggctcttgtggctcctggagcccgcccatggctttcgacagcctcccctcctgctctgcctcttacctggctggtagacagaaggccggatgctggcagtggtgacaacccggggcttgggtgcaggggcggcggggccctcactgtagctggtgtgggtggcaggtgctgaagaggcggccactgcggggctgtaggaagaggcctggggcctggaaccaagcggggaggggttacacccagaaggacagcccccactggggcctgcagtcaaggcaggctggctcccaggtcttcagaagcctctgtgaggacacctgacagagacatttctggggaactgccagaaactgtgaaggaaggaccatgagggtcttggaggggaggaggatgttccttgggtggctagtgccaccgcctttggagagagggagaaaagccaccaggaggacaccgggaagacccttcactctcatggggagagactgtccaggtgggactgtggaagagcgcataggtaggggagaggagagagatggcgctggtcagaactacctacccccacgaccttgtggggcacctcagcccctgaccacctggcctcttctgcctacccttttctattgttgctggaaggaacagcaaagtctcaggtttctgggcacagatgctccagtgagagctcaggggaagtcaggagactgcccccgcctgctgcccaaggcacccccctctcccccaacacacacctcttctgcatagagttcctgttgccctcctccaactgggttagttttcaaggggcctagggtcacctttccccatgtgtggcccagggacaatggggtcaaagagattttaaaaaaagcgtcctagttcattaccctcaggagagtctgtgcgtcgtggcctctcctcccagagagctgaaggctctgagaactcctggaatccagcggcctgttgagccttgtctgatcagtgttccccaattgtatttgtttgtaaaatgcttttcttcatttaaaactaatgaacaccttgcagaacacatccctggtctttcagatctcaaaggggaccacatgcccacacccagggcaaatgggttattgctagaggtgctggagaagtgagccctgcctgccacccccacatggctttctgccttccttctgtctgttcctcaaggacctggggcctgccgatccctgctgggcagagctgtaggatgaggagtgccttcctctctggggctctgagaagggactggccctggcatgagaacccaccaccaagcttctgagtggatccagagaggtctgaggggctgtcccagacaaggcggagataaaatgagcctcagggagctggcatcccagaccagggggctgtgcacacttgccctgtcaagctgccgagtttctggctgagtgaagctattgtctcccctccccaggcccacctgcccttctctggatagattcctgtgctaagaccagcagagtaggggtctccatggaagaggaagagacagtgtccaaggggtgccaggcttccatagtgatgggggcgggccaaggtgcagtggtcttagctggactccatcattggaggacactttgcccacagcccaggagctacaggtcctgagtcagggactggcactgggaaagggagcagaggcttatggcatccattgaaaattctgaagccatgctcccatgaaaggctggggagtccatttgcctcccatgggctcccccacctcccgctccaccccagcccatgtgtgaggagcggaggtagctttgctcagagtgcaaacccgtgaccccttctgctccagccccactccccgctgggcagccagccctctgtgcccctctccaagctccacccaggtcccagctctcctggcaaggcaaagggaaggaagggaggactccccctgtggggggcatcccaagggttccaggagctcagccgtgggcaggcccaggacactgagacctaagcctggtgctggtgcctgcctttgagcagggttggggccccagggatgaggctagactgcctgcagggctccagcatttatagcccctcaccattcatattgggaggcttcttcccactcaaaaacagaggcatttcttgccctcctcaaagtttcatctttctgcaggtagcaaggcctttatatgaagagattctggtataaagaggggaagcagtgtcctaaatccccccaggaaactgggatgaaaccatccctggagggccaggctcctccttcaggcttgagttgggctggggaaaggttgggcttggcaccatgtggttaatgtgaagcccgggatgggggcagcagacaggcctgcaagccggtttgctcacatcaatcccacctcaggctgcaccatggacctacccatcctgatccaagaggcatgtcctccccagcaaaccgtgggggccagggtgggaggcctgggacacctgggctctgaccccaaacactaactggcctactcttggaagcccagacagagagctggccccatccagcctgatgcgccacatggccactgcagagtgacctgtcagcctggcctctctgccttcgctcttctcccctggcctttggtctctgcttgctgggtgtctaggagggcagatgcaggaactcacaatacttgtgtccttcatatgtattaggtgttttacagacattttttctatcataattctatataataagtgttaggtaaacatcttaacagatgaggaaactgaggttcagagagcttcagtcactttttcaaggttacacacagtaagctgtggagcagatataaatcccactataccaggtgcctctggcgttaacatggctgaactctctgaggaaatctgacctgccttccctgcccagctccaatgctgcctcctccatggagccttccttgatttctccagcccacagggacaactttcattctatctaatttgagttccaggaacaaagactttttccacagtccccttttgttatctaactttgtgtgtatgagtgtgtgtatgtgtctgtgagaaagagagagagactgttacctctctcactggtatatgtgtcagagagagacactgttacctctctcaccggtgtatgtgtccctggggggcagagtgacagtccccgccacagtggtgcacacccctgtaattcaccctcagtttccccttcacactctgcaccaagcagcgctggccttggcttcctctaggcctgcgggccctaactaccttggacacagctggccacaggtagacccagagtggggcgtttcctgcctcccttccccagggtcaggcccagcacctgtggcccagttaccttgggctgtcggcaggacttgaagcaggggctgtggtggaggcggaggcgatggcagtgtgggcagcagctgtggccaggggtggcgaagccgcactgggagaggcagcagcaggtggctgggcagaagcgggcagcagcggggtggtggcctggctggtgcacaccggcgcatgctcaataggggtgctgatgaggcgggaccaaaaagacaacaggtcaagggagcctagagaccctgtgaggcccctctgcatgggggcaggtggctgcagcagaggcaggctgggcagaaagctccacctgccttgcaaacagagtaggatcctcagagggtgtgtcttccagctcagggaaggagctcctccaggatcccaggagcagaggctcagaccacaggagggttccagtaacatcaaaaactttttcaatcctggaggaatttcccacccccacccctcaaatttttctgtacttcctaatttttctttttcagcaaaacagtgtggtagaaaggccgatggaattatccacccaggttcctccctgatcctgttttcacccttccccattcagtcagggggcatgtgctaccttgggaaggaatgatacagcaaaaaaagcagagtgaagatatttgagtgtcaagggcttaggctctggagttgtgagaacctaggctttgggctcggaaggactcagggcaccaacaagacagatggctgaaagctaccatgccaggcagagcaaggttacctggacaaaagtgggcactgtggcaaggggattcaagaatagaagcccctgtgccccttttcaaggtcaaccctgaggaagcagcaggaccccagggttccccatgcccatggtgaggggccaggcagacctgaaatagcccaaagatccccatgcctctgtgtggcctgggtgccctagaggatttgccatgcacccaagagtgacaagaacatggtcctgagcacctgcagatctgaaagaccttgtaactgggaaagagaaaggcgaccacactgccagtgtggaccagacgggttggggatgtctcagcaaatgccagtgcaggcagaacctgacagaggaccaggtgtgcccccacacccccaccctgagtgccttggcattctgtaagcacctcttccctagaaccactctaggaagacaagagcagtcagagctgggttgctaactgtaaaatggggtgggcagagaataaaaattaaattataggaaagcaaagaaatgcacattctttactctttgatttgtttttgcaataacagcaactggataaatgcagcttctgcaagtgggaatgactccccctacactatgcagtttgtttattgacctcatgctatgtgccaggaatgatgtctttacttcctcacagcagccctctgatgttggtatcatggactcttatttaatagatgaggaaatggtaacaaagagaattcagttgctcaaggtcctacaacttatcagtaagaatagcaggatctgattgagggatgttgtgatttgaatccttaaccggtacctcatggaggaagaaataaacctcttgttgtgatcagccaagtagactctttccccaataaaaggcactattcttattggaaataattagaataacaatactttgcattactaagtgcttaccacagtaaaagaaattaccctagccaggcgtggtggcttatgcttataatcccagcactttgggagactgaggcaggtggatcacctgaggtcgggagttcgagaccagcctgaccaacgtggagaaaccttgtctctactaagaaacaaaattaggccgggcacagtgactcacgcctgtaatcccagcattttgggaggccgaggtgggcggatcacgaggtcaggagatcgagaccatcctggctaacacagtgaaacctcatctctactaaaaatacaaaaacaaaatcagccaggcgtggtggtgggtgcctgtagtcccagctacttgggggctgaggcgggagaatggcgtgaacccaggaggtggagcttgcagtgagccgagatcacgccaattcactccagcctgggcgacagagcgagactccgtctcaaaaaaaaaaaaaaaaaaaatttagctgggcgtggtggcgcatgcctgtaatcccagctactcggggggctgaacccttgaacccgggaggcagaggttgcggtgagccgagatcatgcatgccattgcactccagcctgggcaacaagagcgaaattccatcttaaaaaaaaaaaaagaaattaccctattactcaattttatcatttaaacctccctgagccattgggattgtgaccctcattttgtagatgagaaatctgaggtccagaaagattgtgtctctagtaaaacatcacaaagctgcaaaatggcaaaaaagggcttggggcctcaccactataacactttgcaaacttccatgtgtgcttgaagcccctggggatcctgttaaaatgaagttgatcctagttgagtaggtctggggcagaactgagcatccacatttctttctttctttttttttttttctcttttttaaattgagacggagtcccgctctgttgcccaggctggagtgcaatgtcgcgatctcggctcactgcaacctctgcctcccaggttcatacaattctcctgtcccagcctcccgagtagctgtgattacaggcatgagccaccatgcctggctaatttttctatttttagtagagttggggtttcaccatgttggccagactggtctcgaactcctgacctcaggtgatccacctgctttggcctcccaaagtgctgggattacaggcgtgagccactgcacccggccaagagtccacttttctaacaggcttccaggtgatgctgatgctgctggtctgtatacaggccacacttggagtagctgacactaaaggggtctgccctagataggaatgcaagcgggccctcagctatttgcaaaagcattactgaattactttccttcatctggtgaggtgtatggtaaaaagggcatgaaatattgtgacagggtcacggaagaatggagctggagaagtggcaaggttgaggttgactgcccccatgggagagagagtgccatccttctccataactgcgtgggaagcttttgggatgggcaagagcagtggttacatcctgcccaggtcttccctgacttaatgctcagggaggcggtcttgggcagcccagcttgcaggcctgcagccgtgcctggccctggcccttccacgaacccacctatgaaagaacctcgcttctggaagccatgccggtgatgtgactgcctcagagaagtagctgcagtctctgtagccacgccactgagctggctgctcagaccctcctctcagtgtgggcaggtatggcctgggacggctcaggctgacacagaacactgatctcctttatctgctctccatggccctacaccacacttccagtaggctgctgggaaatgaggacactgcacaggacaaggacaatgacagtgtccaggctggggacaatattctgtaggatgaataggaggttggctttgcctgtctccttggctccaattcactgttaggccagcttacctgctgctctccgcagccagagctccaaatgaaccctggattccagggcatgaagttggagctggatgtgggccctaggaaaattcatcattgaccacagcaccaggacgatgatcaccaccaggtatacctgggtatgcacgtaagggagcctgctgcttggggttcttgctgagtagcatcctctctagcacactgtctaaagacaccaagaagccagggctagggaaggcagaggaggcatcaaagggtatcttgaaggatcttgggctcttattccaggtcagttcctgcctgaagttccacaaaccctctgaagcattctgaagggggcatcatagagcaagcactgtggagaacttacttggtcctggcttcattcctaaggacagtgctggtgagatcaccccatcctgatctaaggtctacagttgcctcctgccttagtcataattcagtttaaacatctaagcaaaaaccaaatcaaaccaaactaggcccacatgctcatggctccatggggggttggcgtggccaggagaaacacagcctgaccatcgtccccttttcagcttatctcttccctcagtctggtcagcatcaaggtggagcatgttgactgtgtgcccctgctcttccatggtggcccttggtggtgggaatggtggggtttggttgatgctgttattgataactatgatattatgtctggaaaggatgggaatggtggtggtgatgctgggtcttggggttgttgccactgggcttggtcagaactgttggtgatggtgggggccttgtgattggtattgacagtgctgaaggggtggttgccactgtgggggtgatgatgctacttgtgttagttaagatggtagagcatgaaaatctctgttgattgggtgatgatagaatgccagtcaggtggttggtcttgaaattattcatgctgccacccacctggtctatgttccaccttgctgcctggtgactatggctcaggggaaccctgagctgcatcactttgccccaggaatgctccatgcaactccagggcccacattgccattgtggtctagatgaagaacacctcatcagctatagtgtgaaaggcgccctacagcctttgctagttccactttccttcagaatgcattcaaaatcccatagcctgggagtctagatgcagaccactactaaccatgacatcctctgcattctctccattccaactaaaatgattaacttggggttctgggacaccacttctcatcagcacctctgcttgttctgcttagagtatctgtccagccttttgtatctgcttccacccaaattctaaccattcctgatgataaaatacactgacctcttcttccaggaagccttctttgatccaccacttggagggatgctccctgtctctggaccatacatgatcaaccttgcattgggaacacagccgcatcggccctttccgattcctttagcacccatagtagtcaggcacctccacaaatgcccacagacaccggatgctgaatgagaacatctctcctgcttatactgaggggtttacatggaacccagcctggggccccccagggcactacatgaaggggtctggggtaggtgggaaggcagggcttcaactaggtggctccaagagagctccgacaggctggggtctgggagcaggggtccaagagcccgccaactcttagtggttggctgaggctttgccagcctcaggatacccattgcccaggacctctctctatctggcagacccctgcccccaacccacccttgggccttgcaagtcctctgtaaaacatcagccaaatatgagtgtgttccaggaggcctagatgaaggcagcgggatgaaggctgcctggcccgggcatcagactgctggaggcaggatggggtgggaggccagaataggttggcagggggctttagggagcatctcagggtggatgggcaggagagagcggcctcaaacaccaacgcttcctggtgggattgcgaaggttcctggaggcagagggaaagcctctgcccaggcagcaggaatgggcgcagagctctggctagcccagccacagaaaaggcaggacagccttgagggctgggcctcagcatctgcttctaatgtaagtgccaccactctcatgtcctcagcctgtgatttcacacaatcagggacatggaattggcctggagaagctttgccatcatggggtactttctaagtggtcaggcctgggtcaggtgaatggggtgctagctagtggcttacagctcagcaggacatgagcctgaggcctggctgggatctttttggctgctgctgcccttcctagcccttcctaaatgcccaggactaggacaaggccacaggtgggtgggagctgggagcaagacccaggtggaagccttcccagccctcttgcctcctgccacttgagcaagaatctgccagggctgccttccatctcttttcccctgagccccagccctggccccctgagttcccttgtgaactgcttctcagcccaggtgtgcccactggagcccttctctcgcctctggaccaggatcgagcataagtagctccttcctgtgagaacagcttgcggggtgccttctgatggggtggggcaggacaatggctcagtctgctggttgcagcagggtgtggaaggagaggcagggggcattcgagtattcccatatgcactgtcctgtgggtgactaaggttgcccaatgggcctcagcacagattcccaccagccatcctcccgccgtgggttgcagctgggctcggaacctgtggggcaggagagcagcaggaccagagctgcgctgtgtcctggggccggtggacacagcccctgctcctcttctgatggtgcctgtcctctctctgtcccagatcatgccctcacagcccctcttgggtgggacacacacaggcacagcatgactggggcttggtgtggttcacttcaaatcttctttatttcagaacaagcatgcttatatgtacagaagagagaactatggagccagcacacacggtacagaaaggagggtgcatgcccccacctcaccactgccaggaggggtctctgcctcattaccctggggcttctacttcctcttcaaagagccctattccgggctgccctgagctccagagggcagcgagggagccgggcagcgccagggatcagcctcttccccagaccctgatctacgggtgactcattctaggaggggatgaggccaggagctgaggatggtgggaaactgagcagcggcccatccatttcccttggttctggggtgttatgccagcaaacccctcctgccctctctggtctacagctaaggccctgtgcagagggcaggggattgggctacgggctatttggggggtggcgagggttgccctggggaggtttggtgggtacagagctgcagggggctgggccccagcatcagctctggggtgggcagaggacagaaatgctgcggttggccatcagaggtgcccccagcagagttatacattgtcaagcatcaccgtggggctcacatgccagatctgtgtgggggtaaggatggagggagtccagcctgttggggtggggggattccaggcagccttttagcttttaacattaaggatttgggctgaaaggccatggtgccagttgcgcaatttggcaaaacgtgggctgttacgttccgtttcaaacctttccctgtggcacagagagagagagagagagagagagagagaaacagagacagagacagaaagagagagaagagagggagaatgaaaggggttagggaatgtgttcaccattcccctgtctaacaggtggggcagagggcatgggagggagggaacgggcttggagaagctatgcaatccatggggtacattgtaacccaggtcaggcctgggttaggggaagaccgagagtcttggggaccaggatggagggactgaagtccctgccttgagtgagttgggggctgtggagaagggacctggctaatggccctgagggcagactgagcaaagagggcctccctggtccatgtagtgagggctgggcagggctgctttggctgtgagctctcaggattgaaccaaacagacaggtgcacctcgcatgatctctgtcccctagctgggcatcaagaagaaggagcacctatcccccgtgatgaggcttggtgggcagacctgccccttccctgtgctgccctggcctcgaaaagcctcactgtccccagagagaagattttgcacacagcccctgcccacccctgctcgccaggcctgagcacagcctgggcacatgcgtgcatacccacacatactcacaaggtcactgtcacagatacagggccaggacttctggccacttcccaccagtggggcctcttggggctcaagccacacctgctcagctgaggccacagtacagagcaggcaagcagcagtcagaaacgtgggaatgaatggaggaagagagcacctgagaaaggccagtgccacaggcgtcagaatccaggccttccaggctggaagggccgatcacatcctccagaccagaggtgcccactggtggccaaagggccccatccagccacaaacacagtatgtttaacctgtacggtgcttccaactcaatttaaagattaatttctgagtccatactatgagatgcttcttagcaataaaagggaatagatgaactattgggacactcaaccacttgggtgacccccaggaattatgctgattaaaaaatggccaatcttaaatggtaccatgctgtatgattccatttatataacattcttgaaaaggacaaaattatagaaatggaggacagatcacagattagtggttgccagaggttaaggaggtgggtgggtgctggaggggagtgggtatggctataaaaaggcggcatggggcatcctgggtgaagggaagttctgtgttttgcctgtatcagtgtcagtatcctcgttgtgatattgtgctttcattttgcaagatgctaccattgggagaagctgggtaaagggaactagggatctctattatttcttataactgcactgaatttgcaattatctcaaaataaaaagtttaattaagaagttggctgggcgtggtggctcatgcctgtaatcccagaactttgggaggctgaggtgggcagatcacgaggtcaggagtttgagactagcctggccaatatggtgaaaccccgtctctactaaaaatacaaaagttagccaggtgtgatggcatgcgcttgtagtcccagctactcgggaggctgaggcaggagaatcacttgaacccgggaggcggaggttgcagtgaactgagattgcaccactgcactccagcctgggcgacagagtgagactccatctcaaaaaaaaaaaaaaaaaaaaaagaaagaaagaaaaagaaaaaaaagaagttggccgggcacggcggctcacgcctgtaatcccaggactttgggagaccgaggctggtggatcacttgaggtcaggagttcaagaccagcctggccaatatggtgaaaccccatctctactaacaatacaaaattagccgggcgtggtgtcacatgcctgtaatcccagctactcaggaggctgaggcaggagaattgcttgagcctgggtggtggaggttgcagtaagccgagatcgcgccactgcactccagccttggagacagagcaagactctgtctcaaaaaaaaaaaaaaaaaaaaaaaagtgaattgctagcatataaaaatcaggaagagcaactttaagtctttgaaaagaagatgtggcagtgctggccttctatttctgcacagtaacagtcatcggggctggcccccatgtccccacactcacagaggtcctcggttctgcacctgctttacctggcagtctctgtctctctctaccccttgaatcctgcatactgggtctctgtctaagactgtttgacaaaagggacccactgctaacatataacatatttgaaaaccaccagtctagtctgaactttccttatactaagaggaagctgaagcccagagaggtcacatgaatgacctaaagccacacagaaactcaggggcagaatcacaatctaagtgccagcgtcttcttcccttgccacatacctgcctatctgaggttggggtaaaggggtggagatggcatgagcaaagtccatgtggtggggctccttgagtcctgctgacagcactacaaacagtcctgaccatcccgtagacactaccgaggacacaggggcacaagatcagacacaggcagtttgcctgtaaatcgtcaagtcctagcaaggcctgtggaggctgggtgatagtttgtcattagtgcttagtgacagggacagggacagtcctggagagtccaatctagtgagcatgctctacttgaagctgtttaaaaatcctcagctagccaaggaaaggagccaggagaggaaggcacaggagagaggaaaagagacaggagagcaagagcaagaaagacgacctcccaggggctgctcaggcagcggcacctggggcaacatccctggtgctccagttgtggttttcaaactcgctagggtggcagaacaccagggactcaaaatccaaaaaagagaggtaattttttcattgctttcttacaaggggcccattggcgggggcacccattggcaggagggccctatgctgtgcggcgtgtaagcgaggtggctgcagggggggcaaaactgagagactgcgcagcagagggagggaagggggcatctgagaggctgcaggagggaagagggggagccagtgagccctggcattttattggaagaagcttaatggctgcatgatagaaaacgggcatggaaggatttttgcatgatctgggatggaaagggctatgtgatgcaccttcagctcctctagggactcttcactaagatcagctttgttcctaacgcttggaaagatggggagatgcagagctctttacccaggcaggcatcagggaaacgcagaggctgcacttgtaagggatcaggggcatgtctgggttacatgctgggctacatcctggatagttccccccagcagtgggatccagatgcctcgcagatccaagccctgccttgtccccacccctatccccaatgtggctgcccaatgtggatctgaccttttgagtgatcagggccctggaatgcctttccaaagtcagaaggaagctgtggcgatgactctgagattagaggctcagtttgtgggatggaggcactatttcagctacctccgatggaaactggggagccacagcgtcacctatacctactagagtagttcccatgtggaagtaggcagaaggctgatgttcaaggcaacctggacagtttcctaaggtgcctggtccttccagggtgggaagttcatagctgatgcctggcctgttcaggcctcccctacctcacctgtaaagagtccctggaaattagactctgtcttgggctagccagcaggttggcactggagcctcagatggaagctacgtgctaccagacacagagataccatcaggagccaggacccgagaggagaagagggctgtgagctgccctgggactctgggggtggaccttggaggcagagcagtgatggaggtgaagggaaagtttgcaaagtcttcttgacatgtgtattcacacttgacctcgaggtcccagagcccctgcctggtgcagaatgcctgacactactcactcaacattcccgctaactttctcaccacacagcaccaggaaggagaaagcacctttgcatgggcataagactgtgtaggtgtcaccatgcacaggattggcaaacccaggctctgctggagtgagacacttggaagcagtttacagggaagccttcctggggaaactcagccttcaagagagaccctgagaatccccgctgggatttgggaggagaaagagaaggtaggtggctgctctcagccaacaagatgggccaggagagtctaggggtgcagcttcgaacttgggagtggggacagatagaagtgtggctcaggcctctgaggagcaagacccctgaccagcctggaccagggtgggacaaggcatgttcccttctgctcagatagtgatgtaggtgagcctggggccccagtcatgaccagtgatcacacacactgctttaggcttcaatcacagacagattagaactgctacacccactgcacctgcctctgggtccatgggatcactgcttgggattcagtgacatgggtggctctgcccacgaggataactctccagaaattaaagtcagaagaagggagaggagcccctccagacctgggcagaggctggctgggtgcttcagagcctccactgcagggcctgagaccccagagagaggtgctgatggggtgagggaagttgcctgggactgagggaggaagctaactggagccacttcccaggccctcttccccagatttccctagcatgaaaccctgccgtagctgggggagaggctccgaaagctgccttttgctgaggctgaaccaaactttcatggggttaggccgctggtgaaaggactactctcccacccttcaattaccctcaagaccaggcagaacaaacttcaagagatgctccttgaaggagggaaggggaaggccaaggatgaggcctggggaccaccttcaacactgcctttgtgctctcctcactcaataactttgcagagcctgcaaatattccaggggaaagaaaagacaaaagtttgctgcaatgcacttccacagtactctttcccgttctaatgacatctggttaatgaggcacaagctgagcgtgactgccttgcatatcggagggaagcagaacattaaggaaccagaagggagccaggaaggcaggactctgggtctcagaggagggagaaaaaaggccccctgctggcctgttgctggaaggaacccggggggattttgaagccgcttgctctggggtgtgtgatttaaagacttttttatcaaatgtttgggaacatctgcattgcacactgaagcagctacatgggtggcttctaagaggagggcaagacaagcatgggagcagcacgcagggacagcggagcacagcgggaggggagagctgagagctctggcacttaaagcagctggagcttaacttttgagctaaatcaaacatcacttcatcgcggactctctagatgccctgcaggcactgaagggttaagaactgttattgggactgcatgccatccttagcaggcctgggaggaccccaccttaggcttggatgcctggccaaaaagtgggagcaacttgagttggcaaaagtgttggttcaaaaataaaatccacaagtctaagctggctccagagtcctactctgcacaggtcacatggccactgagtgttgggcctgctggttagcaagtacagaaagcttggcccaggatgggagggtgcctctgagccccagccccttgcacagaggctgccacaggatgcactggcccaaggcagacagtgccgggaagaacatgcagatgacatatttgctaccggaagtgtacatacaatcacaatgagccctactccttaccatggaaggccccagcgggttccagtgagttccaggatggcatgcccccccccatgcccacctcatgctatgagcacctgacgggccacagtggtaggttggtggctgtggcctcagacctgcaactgatggggaaaccatgctctaagaccccagcttggcacaaacccatcctcatgtccagggcttgttctttttttttcagcaactattttgctttgagcaacttacagaactggtacctcaatgtgggtctggacaggtgagtccaggggtcaggcgttcacgtccagcacagccccctgtgtgcctgtttctcagtgcccagccttcggaatcatagggggacaggccctgagatgagtgggtgggcaagttggccagccgggtgtcctcacagggaaagttgccctcattctcaacagcccagcaaaggccaaagcagccctgccccctgcccagggatgaagctgggagagcccagagccttcgctcttgtagcctgggcctggaggacagagactcgggtccaggtgcccacctcactgactcacgatgctgcctcaagctagtgtcagctggagccctttgcaggccaggctttccaaatccatgaacttgagaggtcccttccatgagtgatgtgacctgggggctgcccggggagggacggggctagagggcaaggccacagagcctgagtccaggcacttaccttgaccttcgcagagcttcttcatcagggtcttgcactgttggtagaaaggagctggtcaggggactcacgggagacacagcaaggaaagctgctggggctctgtgggcactgagtccccaggattcagccaggccccacacggtgactgcccccttgcctgtccactgtgtgctgggcagaggccccagaggacattgggaaagagtcagggggtagcctgagagggcctcatcccagccctgggcaatcatctcgcccggaagttgcacaccaagcctgctgcccactgctggagttggcattggagcagaaggctgctgtcaccggacagcctgcctgagaggcccagaaggagccctgccagccactgacaaaccatcaagcctggcccaccttcaagggcaggtagcaggactccctggcttctgcagtgctgggcccaggtccctggtggcccctcagcatctccctcctctgcagccaccctgagagcctgcactcactgaattctgtccccgtcatctgggccaggatgcggaaggagcgagactgcaggttggaggaacggcgtgcccactcgtcagcctcatcttctggcttgttctggctcttaatcacagcctggtagacgggagaggcgctgtctacggcaaggtccttaatagggaggctcctgtaatgcagagagaggccgtgggcgagggctaggctggagcccagttcccaccctgctgggtccctgctccatgcccattggtggcccctatcgttctgtccccaccttgcctttatccattgctgtctgagaacctgagatatgggcatgacctgggttctcggtgctcagattggtcgcagtgaagcagtgactcccctccctcatgagagacaggaggctcagatccctcaggtctgcccttccccagtgctaactccaggcctaggccggagacatttccacccctagattccctttacagagggaggaaacagaacaggtcttctttgacctccgtgagcaggccgtgagtttggggctggctggagagaggccaactgggggacacagaggattcctcaggatccatctcctgccctcctcacacttttggatccaaacaaggagctgccaatgctgtcactgccctggaaaaggactgggggccatgggctcagtgtgagtaggctgactctgctggaaagtggtaagaaacaaggcagcaaggcacagccctggcatggcctgtagggacaggggatttctggcctggggaagttgggagtggggctgcatggaagccactggtcctctgtcccagagaagcgcagccctttgtggaggaccaggtgaccttcccttaggctcccagggtctggcacatgataggtgcacaaaactcttggctgaacaaacaaatcctacatcagagccagaagggaccctagagcccctcgggtccagtgcctcccagcctgaatcagactgcagtgcaggccatggtcaaaagccttacagcccactcaccctggccgggggaccagaggaccaagccgcccagcccaccttctcagaggcctgggagggctcaggtgaagcccacaacagtaacagactgctggcccagccctctcctcgtacagatgctgaagctgaggtccagagaggccagccaactagctccaggttacagcagataagggccccattgggtgagaacctaggtttcctggctgctagccctgtgtcctttccattaggctccctgcagtcatagggctcaggaaggctacttctgcccagtgggaggccctggacctatgcctggaaagatgccctgtccagtactcttctgcctgcctctcccttttccccagagggctggctggctgggagaggaaactccccattgtccatgtcttataccctccctgcaaggagtgtgacagggaactgaccttgtgtcccaggactggtccctgtgtctggctcagggtgggctacaagagcagaggtggggaaaggtgatcgaggttgggtggagctgccctggcttcgctgaaggccctgccctggcccagagagctataggtactggcagcctgtggttgggatcggttgggaaagaccagcagaggcttctagggtccggccagggaggagcctgcagctgcccagggagcaaaggagagggtgggatcttgctgttgctgggacaggccatttctggcatagggaggagtcccaggcgttcctaaggtctgggtgagatgggcaacaggaaggcacaaccaggtctccctggtcctggctcctgacccactgggaggggagggaaggagggagtgtgaactgtgcagtgggtgagggaaggtgtggatgcaaggcccttgagcctctctacagagctttgcaatccagagagcaggtggaaggtgtttgctgctgtttccctggaatgtgcccaggaggagctcccctgtgcctttcttggctccaagggttcaagaaagcatttctggcttcatttcccacaaccccgtgcaaagaccagggactcttgttgctgctgtgaccaagactgggagtcagataaggaaactgctgtgcctttcatgacaccaaggctcagggagaatatatgcagggaagatggaacaggtcctgcagtccttggcccttggcctgagtccactctctggacccactttcagcttgttcttcttgccacagaaaacactccacagtcaccgcaacatcaggtcaccgctgcatttgcttcactgtgtgcagcccccagtctgattcatctttcccctcccatgggtggtcatggcaggcactggctcctgcagatacacttcccatgaggattctggggagtggcctccaagaggttaccttgtcaccttctagccctgaataatggcccagtgtgcattctaatgtccgggtctacactgttccagtgcagataggaaaggcggggggagctaccccaaagcacggcaagaagaacacaggtatgcacccccagcctgggcctgcagcatgagtgtcactactctgtgatttctgtgaccacagtgacattatttggacaaaccccaagagacaagtacttgcctgtaaaggctgcaagggatgtcgtttggctgacaggtgggtgtgaggaggagcgtggacagagcacgtgggctgaccactggtcctcagacacatcccaccaaacccacacacaccatcccacaaccagacagacggatgactggacagacactgcagggtctacttacgccagcggtgacgccctgccaagcagaggaaaacccagccgtgagtgcgcgtccatcatgggatagcagaggggcagcgcacacaagagagccgggttagggtcagaaacgagttatgggaatggggtgggtgaaggaggaagaaaaagagaaaaaacacggtcattgaggaaggaaccacggaaattaacagcagaaatgggagcacgttatggccaagaggttactcactggcaccacagcatggtcagctcagcgtggctgcgttaaaaggaagaggagaagaggaccctttccaggcataccaggggaggaatagggaggggatgggaggggacaggagggagatgggaaacgtccttcgtgaagtctcgattaatcaacagtgcatcaattccaaaactgatgggtgccctagtggtgagacctaatgatagcagtcttcccaacgtgcagaaaacagaaagttagtgaagagcatttctttcattattctccattgaacttccctttggccattgctactacttttaagagcacaccaaggacacacgtgacaaagaaatgttaacaggaaatccctgttagctcttgggcttaggcagccttgtttttctgggtacgcatgagctaatgcttgtgtttgtaaacttgcatggtcatattttctgctttgaatgatggaattcaatcaaccttgcccagaattaggcgaagagcagcagccctgagccttgggagtttgacttgaaactccaggacaggcgacctctgctccctggtggcctagaggaagtactgcatctccaaaagggccccaggctcctcagttccagcagagcccagagagcccacactgttccacccttggggctggggagcctgccctttataacctgcatgcatatcatggccacaagggctggggtctggaaaggccaagtgcaactgggttctctgggactttttaatccctccatccctcttattacatcggtttttctggctttggaaaaaagcatcactgtcatttcaagactttttgccttgaattgctaggggatcctgacccagggataagatgttgcccagactgataatcagccaacacagtggtattcccaagtagaaaacagtgaggaattatgtgtatgtgtgtaaaaaagaaacaacagatagacaggacacatacacacacacacacacacacacacacacacacacacacacacacgagggtcgggggagggagagacagagaaaaagcaacaaggaggaagacagaaagagacatacagagagagggagacacagagacacgcagagagaggtctgtctgcatgaatgtttgcattgctagcatttttcatccacaaatgattttcagccaactctttctttaccaaccctcaaattccccagccatagctaatgggtgaattccaggaaccaaggatgtcttaaatgccactgccttgaggccgggcttcctagggcaaaaagaaggggattgctcccatctgtgggactgattgccagcagtagtgtggatggttggtcgcagaccccttcccaaaccagaaacccagccagtgtatttgaatcaattctcattgctggaagaacctggtaacttccccctccttaaaggacagcttcgctgtgagaggcctgggggcctccagaatggtccccttgttaagaggactgtagaagtctcttcttccagcctcctcatagagcctgggaaaatgcagaggctgtgaaaagcactttgaggagccaccattttctgcatttctccacccttctcctaaagctgaccatggagagggtctgaagagaggatacccacgttccagaaggccctggtgaaggctggctcccctccaagggccatgcctccaggaggtccaacgtgagggaagaaagctggtcccgatggtgcccaatggcccatacccctcgggctctggaggcactgagtggcggtggaggagggaggcgcttacccactgaagtcactgccttgggcttgggcctgcccagcgatggcatccatgatggcatcctgggaatacatgctgatgggcgtgttgtactgcgcatggatgatggtggccttgccgcccagccccttcacctcgatgggcttgtgggtggacagggccgagtccttcagggcactggggttgaagcgttcctggtagtcggcgctgggggaggggtgcgggagtacgggcagggagagggaggagaaaagggcaacaggtggcggttacatgggtggccaaggcaagggctgggcgcggtgggtgtcgagagagatctcccagagccgaggccctgaacccccataggctacacaagtctccagatggtgggtggtctgggtgtattcaagaaaatccttggcaccctcccccaaagcccagtgcagcagaaggttttcttttttctttctttttttttttttttgatacagggtctcgctttgtcgcccatggtggagtgcagtggtgtgatctccactcactccagtctcaacctcttgggctcaagtgatcctctcacctcagcctcctgaggtagctaggaccacaggcatatgccactattttttttttttctgtaaagacagagtctcacgatgttgcccaggttggtcttgaactcctgacctcaagctgatccttctgccttggcctctcacagtgttgggattacaggcatgagccaccactcctggccatagaagggtttccttgcccatcttggctttcccagatcccctgcagtgcctggctcagcctgagctccctcccagggtctgcaggggctgccaggcacagagagatctcccactacacacagcaggggaagcgcgggcatggggctgggggtaggggtcgggagcagcagcccaagctgagtccagaatgccccaaaggcgaaaagcggctccactggcacccgcagggattctgagcaaggtttctccgtgaaggggctcttcctgcaggccacccccttggtggcccagggctctgatcttccagacgcttcagggaatgtgcttcttcctcagagcagggctccagctgcccaggccccctcaagtccagtttgctgagtagctggccatcctctacccgcaggaggctcttccctccaatggataggtgcgctccccgggcagacaagatccagtgcagcccttctgaggggtcgccaggacagaaaggtcttcaggctcacacaggcccagcagcagcacagcctgtgtccccctccccctgcacccgccaccgtcaccaaccccaggcacatcttaagcagctgctgcagcaggaaattgggaatgaaattagaaccatcggatggagcccccactcccacccccaaatgcttctactccagcttcacacatgcaggctcacccaggggtacaagtgtaccccactcatacatatgcacatacatgtacacatgccagcaggcacactctatccacgccagacacacgcagacacatgctggggctggcacgcaagcgcacacacatgctgtcctttgatactaacttggctggagagttgactaccacctggggaggaaaagggcaaagaagacagggtggtcagagagaggctccaccaggggcagtttgagcgccggggccatcatcagcctggtcattgtggaggcagaaccagcccaaaccgcaatgggtgaggagagcaaggagtgaggagggagaactcagagccgggaatcacagctactgggaccctcggtttggttcagagactgacacagcaatgtttccctcttgaggggtccccagtgccctctgctttgccagaagaagggttttcttgtctatcttcaggggcactcgtaccgcatacatgaatcccccacatacaaacctggctatagaccccagagtggaagctaggggtggagacaggaccagctgtggctgctatggaaaaggctgaggcccaggggcctccctgcctgtcagcagctccggactaagagtctgttttgtgggggcagctctggaattctgtcctgagcaggcattgcagtggtaaggaggcagggtgtgtgcggggtttcctatgcccccccaaacctgacctcctctccctcccagaagagacgcaggcagctctggctgctcctcttggggtataggggagtggggtgcacagtcaccaggggccactcctaaaggccccttgggccagcaatgaggcaggatggaggagcgagcaggcgcagggagaagtgtgagctcaacagccgaggcagcacagtgagaggccccttcctctcactctgacctgagagtgagcctcccagagcatggtctctgtagggaaagcagtgtctgtcctgtgtttctttaaatgcaaattccctgcagtggcagaccctgtggccagcagccctgtcgggggcctgtgagggagacagtgtggaaggtggggggctctgtccccaaactctgccaccttcttgaatctgcccagtgtgggctgtagctgggggagcttgggccccggccagcctggccctggtcatttgcagccaaaccctgggaagccaggctcaagtcagtggtccccggtcccagggagcagcacagtggccctgctctgccccaggcccgccactgcctcagaactgataaaattccctctatcctcccaggctcaaaatagctgcaagtggagctatattaggaaagggccagcacggagctccattccttctccatttttggccagtgctgacagctgcagggtcatctcttgccctgaccagcccagggccccctgcagagggcagtgttggcctggcggggtgggggctgcctctgccctcccttggcagcctgctccttctttgacatttattcctgcctcctgctcagcttctcccacccaggacctggggccgggatggtggcagcagacacatctgagaggagccagtgcctgggtcttggggaagatgagccaaagatgtaagacctgcccaggggcccttgcactgagtggcctgaggggcactgcccttcagtgccagcctcagaagggaggagaagaagggggctgctgggatgcctatgcccgtctgcccttgcaccacatctgtttctctctcctccttccaagaggatacgaggtgccaaagaattgcactgcaagttgcccagaggagagagtagcggaaggggcttctttttggagccagacaggacagagttcaagttgtgaccctgcctcttcctagcactgtgactccgggcaaattacccacccgtcccagcctgtttcctaattctaattcttgagatggtagtgcctaccccgcaggtgggttgtgcagactgaacgggtcatgagtctaaggtgctcagcatgggagaagtgtgccatggataagcacggggattagcccttgctgaccctgttgctgacccacttagcataggtggtggcctcagcccagcagaggttgccctaggccagcccaggtcagaggctccagcccttcctgccggcattgcctgagacagcagcatcagcttttactttggatgaagcacccactgcacatcctcccctagcccaccatcccttggaggaaacgtcagactctgctgctctgagcaccaagaaataatttacacattcatcagggtctgggcagcccctgcaccgacagcagagtaccttaggcactatgggaagcagaggtgggcctggcccctcacttccctgagcaggcagcaagtccctgtctcaatgcaaagtggagtcaggcagacctgcatgccagttctgtctgccacttactagctgtgtgaccttgggcaaattacttgctctctctgagcgtctattttccagctataaaatggggaaaatcatgcccacctctggagttgcagagagagttgttttagagagtgttgctgagagataaggcatgtggactgttagctggtccatagccagagtgcatggtcagtatggggagacattatcatcattgcaggtgggtctcctgggagtcccaggccaccagaggctgacctctctgcctgaggccagttcctgaaaaggaccgggaagacctaccagcccaacaaatgcgggacaaggaggtcatctctgttctactattccctgagttttctggcaaaagtcctttgctggggaaccctgggggcatatatggctctgtcaccttgggtaagggaagcaagccatgtggtgccagaaatcagcttcactgaggattctagaaagagctgggggggtggggaagctgagggccacagggagcagtgacctgatggggcacaggtgccttctgctgcaagggcaaaggcaagggcatgggcttgggccagactgaccggattcctactgtgactcttctgggtggctccaggcagtgatgataccaggtgtcatgcagtgagtgggtgacagacaaagctcagagctttacaagtgttgggccctttatcctcccaataaccctgagacatggacagtgtgattcctccatgattcggaggaggaaccctgaaccactaggctctactgccttgactcagcctgccctgcctggagagggctatgccaattgcacagggcgggagtagaagttagggtgagagaacaagcgtgaagggctcagagctaacacaggcccagtgtggggactccgttcctttgcctcccccctacagtgccccagtcccatgtccttttacctgctgtgctcccagagtcccgccagctagaccttaggggtgaggctgctgttctcctgcacagcccctttctccttggggtcctgcttcctcgccaccccaccctggccaaggtcactcctgcaaacccgctccctgcacgccactgccaaagagtctctccatatacaattcaagggctccctcctccaggcagcttcccagactattcctagtcccagataactcgcttttccacctctcgaacgctcccctgctcctgcctccgagctcccagaggggtggggacctgtgcatagctcttgaaggctgcaggctgtgctgtcctgttctggggagtggcctagtgaaaaagtgttggaagtcagaatctcctgaattcaggactggctcggccacatggtagctggacaaacggactgtgacttaaccttctctgagcctcagtttcctcctctgcaaaatccgacatgtcaccccagcgtggttggttgtataaatcgctagcatgcccggctcatggcaaatgccgcaggatcactgctgacctcatgggctcggggctggctggattggggccagtgcctcgctctgaccacctgaccaggtctctgccgagcaccgaggacccaggtggcccaggccacctgtggagagctgtatgtccgttacctaccctcctgggagtccgacacccgaggccttccctcggaggctcatctggtacatctgagccatctccctcagggtctctgccgagtacaggccaatggggttgttatattgcctcggctggctcgagcccggcagggcttttgggccgagtaggtcccgggccccctctgggctggtcttggccctcaggctggcccgcggagggccagggtcagaggcctcggcgagtgaggagaaggcggagggccgggagaaggcagggctaaaggtgggcctgagctccggggtgcctggggtgcctgggctggccctcgcctcagggctggggctgggtgccaccaggctgccgttcgtgtccagagcggggtcctggcacagggcaggccatgcaggggagagagaagagagcggttagaggccacacgcgtcccagcgctcctgcgtggacctgaaacagatgtgttagcgcgagccccgcagcctgaagcccagagcgcctgggcgcagcacttggaggggaggacactggtggaggagcaggcaggcacatggctcctggcctggcgtgaggctggcatccagctgggcagagtgccaagccctgcatggaagccaagccaagcttcctgcccccagggcccgaggaagtgggtgtaggggtcaggggatggcccgttctgtgtctgttccccctgcccctgagagtgggtgcccagtgggcacagcccagcctcctgctccactgaccccacactgccagtgagatgaagttcctgggctggttgtgggcaggtggtggggaggtgaggagggaagctgaggaattgggtagctcacatttgggcccctcagtctacctctgcaagcatctcccaagcagccctccacccacttccccagtctgtgacctaccccacccctgtcagcctctttttctcccctctccccactgccctgcccaatctgccccattggacaggtggggtcactatcagctcacatagggggagaagttgagcagggagccctcgggggttgagctgcttggcggggccttgggaagggcctaggcagtggtgaggtctggagccagggcttggcctcccttctcccctgtgcctgccattgccagcacgtcctaagggctacaggggaatgcacttgggaggggcaggtggggaagtggaaaccagagggagagatctgggtgaggccagcaggcccctccacacctggaggtcctcgtcaagctgggcctcagccacagtcacccagcggtggcccccttggcaaatgaaggtcagagcctggacgctcgtcccctgcctggccaggagggtgacccctctcctgggaacactgctgcccaagctggcttcctatcagcccagccacgaggcatagcggaggtggcttgcacccaggcaggcattcattcccacatccagtgttcaacaggggcttgaaagtctctcccaaggggctgcctcacttccccagggtcagctgcagcaggggcagggatggggcagggctgatcccacggcctcatcccagttgggccagccaaagaccaggcaggctggccagggccagcactccaggaaccagggctgagtggaccccgccgccacagtcagcacctaccttctggtgagggatcaccggcagaggggtctggactggaggtgctgtcgtggagatgggaatgggacgctttgatctgtagaaaccagaaatgagaccaggtgaggaagttgcccctggggccagaagctcctgcctgggcagggctggtgaggagagagcaagagagagccagagtcagctctcagagatagctgagtcagagggccccagatccactgtccaccccatgggctggatctccccaagaaggccctgggcccgacgaggatggagaaatcatggcccctgggcattttggtcagaatccatgggcccctgctacgtcactgggggctgcctgggcaaagtggaagtaggtaagacctgccttccaggaccaatggcccacgtacgggcagcaccaggaccaccatctctgccttaactgtaaagtgaggcagtaatgtctgcctctaggtgcttgacagcgacttgggcctgttcattcctctggcccagggctgtccttatcttcctgcacagttttgtagcccagggcggggcccactcaattgctatgggacaatccctcttttggcccctgccccatgcccacacccaaacctccgccccctgctctggagagctcccacctacttctgcagggtgaggctcaagttgtagctggcagacttgatcttgttctgggcttccaggtgggtcatggtgtctgtgttgacgccgtcaatggccaccacgaggtcaccctggctgagctgggactgggctgccttgctgcctggtgtgatctgattggatagtggaggtggggggtgagcataaggaaggtggtcctgaggaaaggccagtccttggggaagagtcacccgggagtattcaacagaagccgtcattgtgtttttcattcgctacggccagtaccagctgctaaccaagcctagttcctctttccggcacatgactaccacattgcttagagctttgtgtctgactgcagccttgggactagctctggccaactgaatgagggtggaagcaatgtatgctccttccaggtctgcctctagcaaccatccttgtgatcctgcacactctctgcttgttgactgactgaatgcagggcatggagaggaggagagatgattaaggagcactgtattggacgttgcatgaatgagaaacttttgttgttctgagccattaaggtttggaggctgttggacatggtggctcatgcctataatcccagcactttgggaggctgaggtaggagaattgcttgaggccaggagtttgaggccagcccaggcaaaggagcccagaccctgtttctacaaaaataaaaatatttggcagggtgtggtggtgcatggctgtagttctagctactcaggaggcaggtgagagggtcactccagcctaggagtttgaggttacaataaactatgatcgctcaccactgaactccagcgtgggtgacagagggagactctgtctcttaaaaatttgcaggcatctgctgggcgtggtggctcacgcctgtaatcccagcactttgggaggccaaggtgggtggatcacaaggtcaggagttcgagatcagcctggccaatatggtgaaaccctgtctctactaaaaatacaaaaattagccatgcctggtggtgggcgcctgtagtcccagctacttgggaggctgaggcaggagaattgcttgaacccaggaggcagaggttgccgtgagctgagattgcaccactgcactccagcctgggtgacagagggagactcggtcttaaaaaaaaaaaaaaaaagggtggccaggtgtggtggctcatgcctgtaatcccagcactttgggaggctgaggcaggcagatcacctgaggtcagcctggccaacatggtgaaaccccgtctgtaccaaaattacaaaaaaaattagctggacatggtggcatgtgcctgtagtctcagctactcgggaggctgaagcaggagaatcgcttgaactcttgattgaacccaggaggtggaggttgtagtgagctaagattatgccactgcactccagcctgggtgagagcgagactctgtctaaaaacaaacaaacaaacaaaaaactgcaggctatttgtaaccttgattagcctcttataacccctgcaccctgcaaagctatggagcacttttcagactccaggagaaaagggagatgcagcagctaagacacagcagcatcccagagacactgccaggctgaagggcaggataaatgcacccactcaaaagcatcttagtgccaggtgctttgtgctacctggcagatgtggagagagtgaggtagccgacaaccctgcctggatgagcaaactcagctgggaaatggggcagggcttagggttctgtagttgatgtcatacctccagaaggcagggtgcaggtgcgggggccagttcccaaaccctgagccccgataataccacagaatgttacagtctggaggccccatcttcagtgtaaccacacagaatgccactgcaactccatcccgggaattccccatggaatctcaggaaggccacacctcctgggacattacttgggatgtcatcgtggctcagactgcactcttggggacatcatgcacgatgccaaattctgcacccccggcctccagtaatagcacactgaatgctttggtggccctgcccacagtaatatcacatgagatgcaaaatttcagaggttctaataatgtcacctaaaaaggcttgatggctggcccctagtgacattagcagccccacccctaaagatacctcatggaatgccagagactctggctgtaccctctgtgacatcacatggaatgggctggcccctgctaatatcacatagaatggctttatgacctgactcccaccataccatgttggaggtccccaacccccatgacatcatgaggagtgccatgcaggcctggccttcagggacatcacaggaaagaggaggctccggaccccaccccctacaagctgtggctggaagtgttccttggctttgcctcccaaacatgcccaccagccagtcctctgggcttctctgggcacatcccagtcaccttcctggctataacccaaggaccaagccagctcctagtgttggcagaagctagattcaggccaaggcccgagaaccatcctagaaggagcccagagaggctctggggacagtcccttgccccaggtgccaagcctgggtgggcctctggccaggctctgggcttacagacatgggtggaagctcctgccagtcccctcacagggaagccccttccaaaccaggatgccctgcagtcaccagtcaccagtgtccagcccattcccagatgggctctgcagatgcagcccaggaactgagttgtttctgcacgaccacattacgggtcacggaaacactgccctacaccacgtgggtgatgacggcaagaccaggacagccctctccaattgctgtgaacctgccatttcagccctaggggctgtggtgccctcttttttttttttctttctctttttttttttttttgagacagggtcttgctctgatgcccaggctggagtgcaatggcatcatctcggctcactgcaacctccgcctcctgggttcaagcgattcttctgcctcagtctccccacagtagctgagaccacaagcgcatgccaccatgcccggctaatttttgtatttttagtagaaagggggttttaccatgttggccaggctggtcttcaactcctgacctcaagtgattggcctgcctcagcctcccaaagtgctgggattacagacatgagccaccacacccagcctgtggtgccctcttaaaatactggccaccttgtgcccacagcgccccttcccctgccctggaatctgcagagacaggaaaggacaatatagaaacagacgtctggactgccaggaagccacagcatctgctttgcaaagtccagcttgccctccaggccccgcaggggcatcttagagctacttgagatttcttaaaatacacatagcccttacccccagactcattgccatagcctctattaatgacaggagtgtattgctgccttgagtgtagaggtgaacaaagtgtaaaaaccaacatcagtgaaggaaagcaaaagagttttctagactgagaggggactcctgggggcaagttgagctgcccagccaggcctgtcctgcagaaaatcaactttccctactcctctatgtgatccccaacattttattatagacatttttgcagatttctaggcaggaaaagtagaaaacattctaaagtgtacacctgaacacccgccaccatggctgtaccataacatttcactcgctttgctttatcacactccatccctccacatccatcaatccatctcatttgccgggcatttcaaagaaagttgcaggtaccagcatacttctttccagggcgaattttgcaatgtctgttctgtcctagtgaactgcccatggggctcccccacagcaggacacccccacagcaaggctctctcacggcagggcacccccaaatgcccatctacagagaaggggtcgtccccctgcagggctgggtcattgcagaccccacgcagaaaggctgtggcctcggtcacagaggagatgctgacaggaaagatgggagttgtgtccagaagatcatgatgacagcatgagcaagggcaacagaatgatatccaagagaggctggggccagatcagaggggccctctgcagggctatctgactgtcctccctctggagctgcctcagagacatctttctcccacaggcatgggtcagcgggcaccagccctccccaccaggtctcctcacttcccctcacctagacctgcctggctctccctcatcctcaggtatgggccggggggatgcttgctcccaagggagagctcagcctcctggggtctggtcagtagccaagcctctgaccagagggaagtggctgagctggatcccctgcccagtgcctctcccctgcagctgtgtctgcttgtcagggctcagctggcctggcctttggctgccctgagtagggtccaacatccctcagggtgggggctgggggtgctgatatcctcctctagggaggtgcttcaggcaggatggaggcagggaccctatggatgatcaggagccatcggatgccttcaccccacctcaggagcagcctgcctgggtgggttggaggggggcaccctcagacccttgcccagagtccagggctcatggagagtgcagtccaggcacgatgcttccacgtctgtcttgtctgactccatcctcctctttcctttctgtgtttcagaaagggcccaaagcacccaactccttggagctgtggttttttctttttaatctttctagccgcctttgagcatttaaatgcctcccttgaatgagtgtttcattcccacttcacatttcagtcttatcccgccaatgggcccctctaaaccctggaaacccaaccctgggtgcagcctagaatggcctcagggtggggcaccgagctcctgtctccaaagctcccaagaaaggctgcaggtgtttggaggccaagatcagctccctgcccccaggagcccttccgccttgctgggccaaggtcttagggcacttccaagggcagcccagggagagctggtgccagagccacttgtgagtgctgggggctgggggcggggaggcagcaaaggaggagcacaggtgccagtatgggccgggcccctgacttcggtgccagcctccaagccctccagtgtcaagagaatgacaatgcctttctcgggattgttgtgaggattatgtcgttaaacaggggattatgtaaggagggtgcagagctgagagagtttcaggaaaactccaaatccaggaggcacagtgctgaccccatctgctacccccagaaggtgtgaggctggctggctacatccccgggctccacaggaaacaagatccacagctggcagagggtggagcttgaggagccagccctgactgaccagttctgagccagcctgctgtccctagaggggcctgggtgttggggggaggggaggaaacttctgtccaaggcccaggggaaagaaggcaccagtgaggcttcagacgcacccatgccatcggctcctatttccccagttccctggcagcagagagagcagctgggctctgcagacgtttctggccatcattcactcccggtgttcaaaccaggcaggcccctgccttcctcctcttctagatgtgccagtgtagatgtggtgggtggaggctggggcaggtggcagataagtaggaagggtacaagtttcagcagctccccctccccacactcccaggctgcctgcctgggttggggcaggtgggacaaagtgcattttcattgtatgattaaattactgtcttgtcctgctctgctgccttcccatctggcctcccctggggctttgctcatgctcaccctctcactggaaccttctgtctccccatggtcccactccccaactccaccctggccgataaataagccggagtcccctcaatgctcaaaaagcctctccctgcctgcctgggtggctccaactggctcctgtcatgtctcctttctgcacctccagactcctccaagaagtgacccacacatcctgcccccactgccgctgcctcccacctgctcacacacagccgtctgcctttggccccattattccacgcatatcaatgaccttctgtgtccaaagccacgggtcactgccccctctgtagctgaccacacctcccctggctttcctcaagtgtctcttgagtctctcctgcctctcttcctcctgtccaggtccacagttccatttgggtcttgggtgtggccaataaaatgccctcatgggcactggctctcaagggcccccagcaaggcccattcttgtgtccaaggatggttcctgggcagaggtggagcctggtcccaaaggggtgccaaagctgtgtttgggggtgggagggctcagtgtagaggagggtctttgcagtcaggggcagcctctggatgagaggggaccatgcagaaagggaaggagactcagggaattggggagctagcccccagcagagcctggcccagcctttctcaaacagccctgcagtcctgacactggctaccccacaatatctgtaggcccggagccctggggctgcttatgcagctgcccttgcacggtgtcctggcccaggggcctccaagggtccaattcattccccaggacccagccagcctcatgtcctctccttttggatccctcacagagttagatgcagttctgagcagcccggaggacctggcctgggggacctctaagaatgcattccccagctgtgagcctctgagcctctggccgtttatcttcccctgttgatagatgttgcagggaggcccctgccagccccactgaagccctcggaggcttgcctgaccttcagtgcggctataaacagcacggcctgtcagcactgctaagagctgcccaagaaacagcactgcgtgctccagcggccccgaaattccaggaattgccggcacagctaccccagaatagtctcagcctgtcccccttcctctccccagagaccctctgtcctcagcatgttcccaccacagctgggagagtctgataaatactggaaccgaaacccacagagaagaggcctctgagctggtgctccaggtgagcctgcaggcggggtggctgagaccctaggaagagagggtttccagtagacaggcaggcccctcctgggcccaggctcagcccccgactccaccagtctcacaaccagtcccagtagacaacaggtggaaagttttcacaagtgcctgttagaaagagctctcacaggtgtggaaggcatcattttatttgtttatttatttatttatttttaagatggagtctcactctgcccccagaatggagtgcagtggtgcgatctcagctcactgcaacctctgcctcctgggttcaagctgttctcctgcctcagcctcttgagtagctgggatcacaagcatgtaccaccacacctggctaatttttgtatttttagtggagacagggtttcaccatgttggccaggctggtctcaaactcctgacctcaagtggtctgccccctcggcctcccaaagtgctgggattacaggcatgaggcaccgcgcccagcctgctatccccattttaagggtgagaaaaactgaggccgagcaggtaaacagacttctgaggtgacacagctgagagcagcagagcctaacaaagcatactcctcttccccaaggcggaggcatgagaggcatgaagaggtgagaccccagaccacagccccagcctctggccagctgccagggcagaggcctttggagctgctccctctctgggctgctcccccttctccacttcctggagaactggctggggtggggtgaaagggcagctcatgttgcaggcccagccacacctgtccaggataaataaaggcatttccccgccaccctcctttcccagtctccctcttgaactcccttctctgtgggtctgcaagcagagaccctatgaagggatgccttgaggggctgctgctgccccaaagttgctgccatgagcccccgggagccaccacccagcctgcaggtggcctgtgtccttccaggaggagctgcagcacacacctgcagctgagaggggacagaccctccccagtgcctctctattagtcccagttagaggggtgagcaagccagcatgggagttaggggtgacaggatacaggagatccacccatggacatccctgtcctgtgagcagactcgagcctcagtttgccaggctctgaagcgaggtaacgatcccagcctcgcctgcctgcccaccccacagggtcacacactcttgcctctggtgccctatggcacaggctcaggtcctggctggggtgggagtggggttcctccagagagctctggccatgcctcccccgtagggggatgtccctggtgcagaagggccctgcgagccccggcagtaaatcctacagccctggtgggatggcagggctgtgtccacaaggcctgccctgccagcggcactgaaccaggacacaagcccaggctatcagcagcctaccaccaaaatttctcaagaggctccgagccctggggaaggctccagtacccagtccagcctgctccgcggcttaggtgatttggggtatgcccctaaaggaagccgagaggccatatcatgcccatcccccggtgccctgcccgagcttcgggttctatttttagaagtccccccagtcattggatccagcacatccctgcataccccctccccagagtaaggacattcctcctgctatctagcttaaggcttctgggctgccatttaagcccctggctggccggggccaggtggcacatagaccctgggtgaggtcattggctatcctgagtgccactgagcccagtggccaatttgcacccatagggatagggcagggagcaccagcaggaggcctcgagatggtggagctgggggagatgtgggctcagtcccaggcaggggaggccacagggcccatgagagagcacgcagaggctccaccttatacaggaaggagtcctgcaagcatgggggtggggagctgtgggaaagggcagtgggaaatccactggggctcacatgctcacaggtcaccacctcatgcaaagtgtgcaaggctgtgggtgcccaggaccctgtggtctccagggcagtagatctggaggggtggaatctccaggttagaacaagccacatctgcaactgaaggatggaggtcagggcctgttccctgcaccagagccaggccagcacccctcctgtaagcatgtggcctctatggctattataaggctctcacggcatccctgggtggggcttctacttctggggtcccctcaagtacccgtggaacaaaaaaagagattactcctccactgggggcattggctcctgacccgctgcccaggttccctggcccctctgccaagccccttcaggccttgcccacttcagtgcttcccctccaaccccttcctccagcccccaggcccaaggcaagtccttaaggccccagagaagaaactgtccccttgttcccctggtgggcagtagcccagatacccctgcctacctaccaccctccagtgacagactgggggcctccccctctggccttgtgcccggaacagcacggtcaggggctcagccaccaggcagggttgtccttgccctgtatgcctcacagttcgccctgagccttggggccttcagccctgggtctaccagtgccttgctggggagtctctttgtttgacagaaactgacggagtgcctactacggtctgggggctcttcccccatcagtccctgctcctggagtgcttcctcaggagcatggctaactttctgcctctctggtgttgctgtctccagccaggcggtagagttactcagacaacccctgatgttctgtgtcatctgcatcaggccatgctgctccccatcacagacactgcaggatagggggccatctcaccaggccccagcacttgtcgggaacaagacctgagacagacaaagcagccatggtgaatggggagaagcgcccagccccatgagccagggtcttggtgtctcaagtttgggatggagcgggtgcccagtactcagtccagcccagccccacactctgacagctgggcagccaaggtcaaccgtctgtctgtccatctatccaactgcccatcacctgccctctccatgctgggaatactcccttcccaaagcagctgcccatatctagggaaatgctcaaggcttgggggcaccctgagcccactctaacagtaaagggatcaggaaggtgctgtactctctgtccagctacctgcctgcctgcctgcctgcctgcctgcctgaaaactcagcattttcttctctgctaaaaacacctaccacctgctcatgatgtctcacatgcataacaggccggcgcgctccagtgagcaaacagctgtggctgagaccagaggaccaggccagtcccaggggatggggcatgctctgctttctgagaggctcagaaaggacagacagacagacggacacacatgccctcctccaagcgtgcctgccccatcgggtgccaggctgtggcagggtgcactcacccgggagatagtgaggggcatgttgaagtccttgcccccctgcagacggaagccccagggcccgggcccagtcagggtcacactgtaa

SEQ ID NO: 1551 - DNA, 6327 bp, Homo sapiens
taatagttttttgttttgttttgtttttctgcctatgaagttgccattcttttattcctttactttcctaatgaacttgctttcactgtattctatggacccgccctgaattctttcttgcacaagatccaagaaccctctcttgggaaggaggtgggggccgggagcgcaaatggcgttgagatggttcagggccctgttcaaactccagcactgaccattcaccggcggaagcggcggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcactgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattgttcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccataaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaatacacat

SEQ ID NO: 1552 - DNA, 3828 bp, Homo sapiens
atggttcagggccctgttcaaactccagcactgaccattcaccggcggaagcggcggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcactgtgctgttggaacaactggccagaaatctatctctagagtga

SEQ ID NO: 1553 - DNA, 31632 bp, Mus musculus
tctaacactgaagtgggtggaacatccttagcaataggaagtctaaatacttagccatacaaggcctccttctgaaaatcattttaagattatttctaagacgtattttatgtgaatgttttgcctgtgtgtatgtatgtatgtatgtgcaccacgtgcatgcctggtgcctgcagaggtcagaagagggtgttggatcccttggaactggagttgtggatgagtgtgaattaccataggggtgctgggagccacagcttctgctggaccaacaagtgctcttaaccattgagccatctccagactctgaaaaaaccttctgtctggtctcgtaatccatttctccagtttccagacttcacctgttcttttacctgcttatatatgccagcctcgtgccccatgagtgtggggacaaggccacagaggcagacagctaagtgtttgctctccgcagcagcatcgattcgcatcctcttctgttctctcagcgcacctcaggccagagcctccagccgggaggctgaacttggaccttctccgcctcggtgttcctttacccccacccactgcatgtggctcttggagaaagccggttatagggtacggaccgcagaggcccgggcgctgcaggcgcaccccagcctggtccccaagcgccaggcccggggctcgccctcgcgctgcaaccctaatgtcctcacccccgaccgcatcccacagttcttcataccgcctcggctccgggacccaagaggcgccgagggcagggtggaccgcaacccgggcggccggaacctcccggtggcctgctcgctgccgcacctggcgggccgcgagggctgggccttcctgcccgagagcccgcacacgcgtcgccgcgagtccttgttccacgggccgcgcggcctggctgcaggcctggccccggcgcagtcacggctgcacgtctcggcccccgacctccgcctctgccgggccccagacagcgacacggcctcgtcgccggactcctcgccctgcggctccccgcacacgcccaggccgcagtccctgtcccccgacgaggccagctcggcggacactagtccgtacgcgccgcgccgtgcgccaccgctcttccacctggacttcctctgctgccaactgcggccgaccaaggacagcgtgctgcgcctggggccccgcggcgggcagctgcgcctgtccaccgagtaccaggcggggcccgggcggctgaggctgcgcctggtgagcgccgaggggctgcctcggccgcggacccgcccccgggagcggtggcggcggctgctgcgtgattctgcggctgcagccgcgctgttaggcctggagctcagctggagccgggtggtccagggcagctgcaaccctatcttcaacgaagacttcttcttcgaggggctgcgcccgccggatctggccgtccgcagtctgagggccaaagtgctggacaggggcgcggggctgcgcagggacgtgctgctgggggaatgtgagacgcccctcatcgccctgctgcccccactggctggaggtctaggccctgggtcctccctggcacctactcatctcagcctgtagactgatagacaccacagctttcttgggaggtttccactgggtctgcagacttcatccttgccacctgcccggcatgtatttatttttgttaataaaacatcagtttgtctctagctgcatgctttccagtgggcaccaaaaactctaggctttgcagcaagtcttttccacccagcccttccttaagcagtgcttgagacccggaatccctggaagtgcttgttaaacatggagagcctagagtccatccccaagcgagtctgcttcaagagtcctagattgagttggctctaggtgcctgtcttagctttatttccgttgttgtgataaactatctccccatcacacacacacacacacacacacacacacacacacacacacacacaaaagcagcttttatggagaaagggttcatttggcttacaattctagatgatagtacaccattgtggagaagttattgccaggacttgaagcagctagtcacttccacagtgaggagcagggagagagacaatacaagctggagagctggttcagtggttaaatgcaaaggactcaagttcagttcccagcacccacatcaggcagctcataactgcctatcaaactacagttacaggggatctaatgccctcttgtggcttataaaggtcaggtgggtgggtacgtgcatatgagcgtgcgtgtgtgtgtgtgtgtgtgtgtgtgtgtgtgtgtgtaatgcccagggggagtggcacatgcctttaatctcagcactctagatgcagaggcaagcagaggcaggtggatctctgtgagttcaaggacagtctggtctaaagagtgagttaggataaccaaggcaacagaaagaaactttatctggggctggagagatggttcagaggttaagagcactggctgctgctcttcctgagttcaattcccagcaaccacatggtggctcataaccatctataatgagatctgatccccttctggcatgcaggcacacatgtaagcagaatgctgtatacacaataagtaaatgtgttttttaaaaagaagagaaaaaaaaacgttgtctggaaaaaagaacaaaataataacagagcttggtggctcatgcctctaatcttagcacctggagggcaggggcaggtagttctctgaaaattggaagctagtttgatctacaaagcaagttcccggccagcaaggcctgtgtagtgaaattctatctcaaaaaacaaaacaaaaaattaaagatcagagagagaaatgaacataatgtgtgcatgcatgcttctaatgcttacttagttcagtttctccacagtccaggacccaaagccaggggaatggaaccacctacagtgggtcagtcttccacatcaagtaattgcaatcaagagaatcccccactgacatacccacaggccaacatgatctagacttttctcttcccaagagattctagactgtgtcaagttgacaattaaaactaaccatcacaggtccctcgagtctaacaaaaccctgcgctttcagagagcccttgagtcctggtgtcaccccagcaagagcagaaagccaccctctcctaaaggtccctgtgtctgaagagaagaaactggcctttcctaccccttagatcaatatttgtcctaaagacaaatgaaatttttgaaccttaagagtgagccaggcgagcacagactaaacacacagtgccctttaacccttcctgcctccctctggctagtccatacacctgtgcacctgtgcaggagcaggaagaatggctggagtcaagaaccaaagagtaaaccaggtatgctagcaaacacatttaatcccagcactcagcggcagagacaagaagatttctgagttcaagtctacagagcaagttccaagacatacagacaccctacaggggctggggggccaggggagaagcacagaatagtgcttgggtacccataagtacttgggattatagggactgggatctgggacagaggatactatcaagggagtgagtgctgttatcagggatgccagaaaaggctactccagccagaagatgagggtgaaagacagtggaataaaagtgggtcatcttgtgtttacctcctacctgaaagcccttgacgtcagcagtgaccttctctctgcctcttccttcctgggaacttgttcctcctgccagacttcgaagagggatagagaaaggcaggtacacagcaggccctagaccacttcctccttcctcttagcctttctcacttcccatggtgccaattgtccccgtataggacctgcttcttcttaacaaaaatctcagcaggggcagctacacatacacacacacacacacacacacacacacacacacacacacacaagtcacccttctcaagctccttctacctccactaggttcccaccaccaatccccaggccaaagaaaccttgctccagttgtccaccagatggcagcattgaccaaacaatcctccgtgctgacagcaacctgatcaatgggtaggatggacagcttcaaacattagttcctcctggcaactgcctctaaggtgagtgtacagttgttattcaacatgaccttcgcccttagacagataataaagaagaaaactaggtgacatgactcaaggtacttgtcacgaagtctgacagtcttgagtttaatcctagagatccacttggtggaaggagaccaatacacacatataatgtaacttctaaaatctgtattaaaagcctgaagggtttctttttcccgggataatagctcttcagtcacttcacaacctggcacttcgcacttaaacctgtgaactctgagaagtccgcccactccccaagctctatctgtgctgtgctgtgctgtgctctgtgtgtacatcggccctcaagttctttcataacaatccctagtgagcaatgcaacttggaagtatctggaaggatgtctataggtcagtttgcccgccttcatcagttcctccagcaatggtgggtgctataggatgccaggcactggggccagcaggcttgaaaacaaacgcaggaatcaagtgagtcagaaaatgaacaaatatcagtaaagaactagctggcgatgggccgtagagaaaagtaaagtaagaaaggggagggaggcaaaattacaggaatggaaaagagagggagggcctgaaatacttttttagctgccatgtgtactttgtaccaggccttgcactttacccgctgtcttatctcaccaccactgggtaaagtaggcattaccagttcacaaaggcagaaagagatccgagaggttaaataaacttgcctgaggattggctttggctgtgaggaaggcttctaacagcgactctataccaacatcctctgccacaacccagcccaggaatttggggagtctatgagatagaaaacacctcccccccaaaaaaatgttctgtcacattcccagcccccggggctcagacaggtacaccgagtcccccagtctcagatacataccatgggagcaaatgaagcctaagaacccatcctgtgtgcaaggagctgaggcctctaagtaccgccattagcacagtactgccaccaacgcaggtcagcaccatggttctccccctttttagctgtgacaggattcagggcgcatgggtgacacccagcaaaccacactgttaaagtcttccttgtcccccaaaccagacctcccaattttgttcctcgtaattgtttttgaggcatactctaatgtagcccaggctagcctcaaactccctacccagctgaggatggcagtgaactcctcctgctcttccagcctctaccttccaaggctagacatacagtaaagccctgccaccgtgtcacgttatgaggtgctgtaggttgaatctcgggctccatctccagccctccactcctgatttttcaatcctcccacctccagtcccacctcagtgttaattgggaaatgagagctataagcagttccagggtagggctaaagtccatctttcccgctactcctccatactggggctctacataggtaccaacggggatgcagaaaccacggatgtgccaaagagcttgcaatgtcttttttttttttaatggccaagatttcatccactccccaagtcattctggggagttgaagtctccgtaagcctgaagctcaaagaaaggtagtctctactgcactgcagtagagaggctccagtgaaagatggcgccctctgggccaagccagcctctgcatgctgcccaaaccccagaggtttcctttttacctgctgccttgggtcctccctggaaggacaggactgtgctgagctttaagtggtttctgcggttttaaggggtggggaggaagggaaagaagagttggtgactgctccccatttccaagccgccgccgccaccacccacctccaggttgtttgccccctgctttgagattcctgggcctgataagaggactgggcacgtggggtagagtgattctctgatccctatcagcctcttccttgcataagaatgtatttgagtttgctaggcccggcatagtctcacaagagagagctatatctgggtcctttcagcaaaatcttgctagtgtatgcaatggtgtcagcatttggaagctgattatgggatggatccctgcatatggcaatcactagatggtccatcctttcgtcacagctccaaattttgtctctgtaactccttctatgggtgttttgtagaagtggatgatcacagtcagctattggatgggtcacagggcccccaatggaggagctagagaaattacccaaggagctaaagggaactgcaaccctataggtggaataacaatatgaactaaccagtacccgggagctcttgtctttagctgcatatgtatcaaaagatggcctagttggccatcactgcaaagagaggcccattggacttgcaaactttatgtgccccagtacaggggaacgccagggccaaaaagggggagtgggtgggtaggggattggggggggtgggtatgggggacctttgggatagcattgaaaatgtaaacgaggaaaatacctaataaaaaaaaaaagaaaaaaaagaatgtatttgaggaggaaatagcccctgctctgctttagaaagcactgttcctacagaaaagagccttggttacagcaagccaggggtggggagctgggggtgggggtgggggtcaggcaagaacacccagggggcataatcaccacaacctactctgagctttaccagcccggtaaatcccaaggtcacactggatgacagctgtacactcaccctatggccactgtgggaggaacaaatagttgaagctgttggaacagttcctcctgtgggcgtgatctcctgatagctggaagcacagagaactctctggtggcagtatcagtctgaatagggaacccccaccctaatcacccacccccccatgctggaggcagggccaaaagctgggtaggatgatgcctgtaatcccagccctcagaaggctgaaggaactggatagccatgaatgttcaaggccatcttggactactgagtgagatcatcttagcaacacgtaggaatgaaggtctcgaatgctgaaatgaaagagtagcttagaagaaagccactctcaagccaggacccggtcgcttcctgagccctcacagtcattctgacagtgccaggcagtgtctgccactgccatactgtgtggcatctgaaagcatccctaggggcctccaccctgtgcctctagcttgagggaggggtcatctggaaggtcttaagacccataatcaccaagagaaaaggacctggtcagcgatgcaggtctgtaaccccagcacacccaaggcaatgttgtgagttggaggtcaccctaggaaaatgagaggaggggcggggttcagcagttaagagcacaggctgctcttccagaagaacccaggttcaattcccagcatccacacagtggctcacagtcatgtatgactccagttccagggcacctgatatctttttctttcctgcatagtgaaccaaacacacaaatggtgcacaaataaacatgcaggcaaaacacccatactattaaaaaaagataagtgaaaagaagaaagaagaacaataactaagggagatgaaagcgagctggtaaggcacagaaaactgagcagtgatgggcagataggagcacagaagagcaggaggggatagctctgggatagaggcaggccattaaggtccccatcctttgagtgccctaacctttccagaagcctctttctgactctgttcctaggtaggggtgccatcactttgcctcttttcaaagctctccagattggcattgtgttttgagaagaacagtatacatgggcctgtttaccaccaaagaccgtgaagtcagagatgacctagtcagtggagtactgccacaaacacactggggtcaagggttttggggggttttttggttttttggtttttgttttttaagatttatttattttatgtatatgagcacactatcactctcttcagacacaccagaagagggcatcagatcccattacagatggttgtgagccaccatgtggttgctgggaattgaactcaggacctctggaagagcagtcagtgctcttaaccactgagccatctctcctacccaagggtcaaggtttaatcccccagaacccacatcacaaaatgggtacagtggtagataggtaggtaggtacttgtagtctcaacaatggggtcgtagaaaccctagaaatcacttgccaatctggctaaccaagatggcgagttctccgttccatgggagaccctgtctcaaaaaaacaaaacaaaacaaaacaaaaaggtaaaaggtaattgaggcagacatcaaattttaatctctatcctccacagacatgcacactcacacgtgtacacacacccacctatacagacacacacatatatgtatacatataaaggacttaggactagtcaaagcctcaaaggccctcaaaagtcaccctacacccctacacttttcagtctccctggggctaagaacggctattcctcctaatctttgtctctgactcttaggagactcagctccctagagcactgggtgctactggttgcacagtgtgaagctccacggagggccaacggtggagaatggaatgctgggagcgaagggacagctgcctgccctctccacgctaggtgccacgtgcaccaggtggagggagtgggcgagtcacgaggccctggcgtggccggctcctgccctgctgtttaccagctggagaaagcaggaggaggggttgggagcctcctgctcccagcctggcccctagccagcggttgttgggtaagcaggaaagccaggcacagctaatcaaactctgggcaaaggacatgccgaactgaggcatccaatattcacagaagtcttggctcttggcccttctcagactccagtgcaggcctttatgtgaacagaattacggggtcgtgggggagggggaagggagaaccgggaggaggggggaggattccctcctctcaacttgttggcccagtgcagttgctctcttttgctctccctccaacacccctcacctctcaatttgctcttcctcctccacacctccccccaccacaccagaagtatgggaagcatctagaagcctggaaaatccagaggtgggcagcatggagttagagagaggcaaagcaagacatgtgctgggggaacccaagctgcagggaagtatatctgatcccatcctggagatcagagtgcacacacacacacacacacacacacacacacaggctgtcttttctcttcactcttcctgcctccctttcttgctattctgtcacctgtcctaaaaaagttacagagaccaggttcaaatctcaactcaatcacgaattgcccttgtgaattcctggcaagtcttttctattctgggcagcaattggttcatgattatgaataatcactcgtgcctgtagggggttatcatgtgggattccaaaaaacaaacaaaaaaattctgatttacctacaaggcctggcaaaaactcagcatacagtaggtaattaaaaaatactagctccctttcacctgtttttcctcaagactccagacactggtccactgctgtctccctgagtcccctcctgtgccaggacactctgccagccactcctttcccctgcctgctgacgggccaggtgctccctccctcttccctcctccctcccttgggccctgctccctgccctcctgggcagccagggcagcaaggacggcaccaagggagctaccccatggacagggccccacagagacaccaccggacatctcggggtaagagaccctaaagccctgcaggcaggtggaagggactgtcagggggctcagaggaggggagggaggcgaagagactgggaaagaaagaactggggagaagagaggtgagcagaggggagatggactggcagacagagcaaaacggtgagataggaccgagtctttacataactgtaggggggggacaggaagagggcctagggtaacagcaggagacctgggaagacggggagggcaagaaggaagagacaggttggagtgggggcaggagggaggagctgtgttagggaggcttgatcgagaggacgggaatggggctggctcccaggtgtgagcaggcccctccctgcctgccacagaatcctgggcagcagcggctggaagggtgactctccgccttcctattcattcacaagtggctgccgttctggcgcaggggctgggggtgggggacctgggagagaagatgcagttgcaccatgccagctgctctagcccagcagtcccacgctttccttcaagctggtccgagcacggagttttatctttgctgtgtgaggcacctgtggagcacagaaaggaactggggaacagtcccccgatggagtgaggagggagcccttcagaacaggacatcccctccctccctcccatgcttgtcagctgggaacctagagagagtgaacgacagaagtgccagcttctagggccactagagaaaggctccggggtgggagtgggagtgggggccaacaaggggagtgtccccatgcaagactgctctgaattgcaaagttggaggctggacaagggtgccacgtcagggaggaaactgagtagggccagacaggattagcagggaggtgggcatggcatgaagccacaccctctctgggcagaccttcccctcccccacccggggaacaggctaccaggccccatttactatcacggcaatgaaatgcaggaagcctggctgcagagtgcatctcctggcagagggacagtgaaggagggacaggacatgtgtgccaggcttggacagcagaaggcaaaaagtaacagaaaggaatcaaaggttagggacattacagacagggctaatgggctttctggaacagaagactggccctaggcaccctggatataggaaatgggttgcggcctcttttgccaagggctccctctctaggtgtttcccaaatactgactgcatgctgatttcatcccagatatgtaaacagccctgtaactatgcagtaaccatgactctcccctcagctgctgctcccctggacagcagagcatctctgtaaacctccacgaaccatggggtgcctcctcctgtctgatctccacccagacccatccacgagcaaagcagcaaggcaaagggaccttccctctgcaggcttgtgggcaggtgaagcacagtggcggccagagagggtctatctgcagctcggccctccttgtcttcctcttcgcccaccctccccatgcactcccagccccacacctctgcagctccctcttgctttcaggcacagataagcaaccaaaagactgtattccctctgggtgcagaatatgtgtgtacgtcaaatgcaccagatactagagggttcttgctgttccccagagcaacaagctgaacaagacagacagaggctctgtctccagacgggcttacaatatagaagggatgatggcatacctagggcagttgtctgttacgtcaagtgccaggaaacaatgcagagtgctggctgagtaaaccccagggcaggggacagggcatgggaggctgccccagaggaaaagagagacatctgagatctagctaaatgggggagggagggtagagtgtgacatgaggaagtcctggaggcagagaggagctgggcactttcaggacctggaagagggccagtgtggccaaagggcaaagtgatgggctctgccaaggggcccagcttctcagaggccaggtagtgctggggtaaaaatggggcagggcaggagccaggaactggggaagtctttggcttttcccctaacatcttcaactattcactgatcccttccttctctttacagagctgctggctgcaaagaagacccacacctgtgagtaggggtttgggccaagaaggtggcatggggtatggcaaaagcattcagttcaggaggcatgagtgaaagaacacccgggactggacagaattggaagaatcaggctaagactgcaaagcccaagagataagggccaaagggaaagactttaggccaggaccaaaaaaaaaaaaagaaaaaaaaaagaagcccaaggggtgccaagttacaagcatagaaagaaaaggggaactgggaaagaggagggcagggtgctggacagaggctcagctgctgtgtctgaccagggaggaggtgaaggccaccccagcctcagaactcagcagccacaataggaggcctgggagcgtgcccagggctttgtggtggcagagccaggtttggtgttcatctctgtggttaacacattctgaggtgtgagcaagcctggagagaggctctgcagagctagagagcaggaaagccttgtctctgtaagaatgagtggacaggaacccgaaatcctcagactgcagtgtacgaggaagagaccagagttccagaagggcttcccaatggacacttgcaagtaaacatctgtctcaggccagtgcagcacccccaatccagccacatagagagaagctattcccctacaaaatgtgcccgctccaccaaagtcctccccaggggttcgtgcataccctcagcaccttgggggcactctggaaaagccacaagcatggtcattaagttaatagtgacaatctcatcagaggaggtcacctctactcttccatcacatactcattggttgcccaccaatctgtccccactacaaaagccatctgtggccttcctgtcccagcatccctcctccctgagcttggggctccatcctcctgggggggtcagagctgcttggctcagcataatcctgatcagcctcctgtgcactagccacagggccccacggaaacgctgagcagggccctgggaggaaagcgagtcagaatgacgcaggcaagctgggggaggggaccagggaccacacttgggggtgtagagggggacttttggagagtggaaactgggagagaccaagccaagcttttagacctgcctcccatcctttaacccttaccatgtgtcctcctgaggatccaggctagttaccctcatccatccaatgtccaactcccaagctcgcagagagagctttttactaaccagaaagattgaagacctctcaaggaggttgagctccttgagtttttattgtcttggccccaaccccaggccaagacaataaaaactgcctcccaagtgaaataacctcaagaaaggggtccaagctgagaaacccgggggcacacccagaccaagaggggaccgaatgactaaggggccagaagaggaacctccaaggctgaggtaccccacagagcagatggaaaacaaatgaatccatcaataagaaatctcacaccaacaaaacctgaagagaaactcaagtgccaggagacgggccagtctgagacacactcgaatgcaaacctgaaccagagatacccttctatccctccagtggatctgaggtcactctacctggccataagtccttactcaaccattcactactgtgtgatcttgagcaggttacttaatctctctgtgtctcaccttccttgtctttggaatggtagttatcacataaagtattttatggggattatgaagtccacacagagctgaatcattcccaacactgaattaagcactgctgctaagaggatgaagatggtagtgtcactatctgtgtcccagactagcagtcttgtttccaaaggcctttctgaaggaccaacccatcctacagatcctacagagggtatttgcctgatgatactgccgctatcgtttcctcagcccaggatagcatcatgtgtaggaggaatttgggtgtggtgagggcagcctcccggttgtaccacactggttatggctgttgacagtccacagggtctcagtgccacaagacaccacccaagacagattcctgttacttacctttggaacatccctacccctgatgtcacttggtgaagagggcctggggtactcaggagaggggatttcgagcctggcctctgcccatgagctccacgaagctccccagctagaactcccctggcgagtggaaacagcttttaccgcggctgtagctgtggttttggaattttccaacgccccctgtgattggctgccccgcccctcacaccctgccccagacccagattggccacgtggggtgcctgtcatcatacccaatgcacctctgggggttggggggctgtcacttggccacctgtgtggagcagagcttaaacccccctgcccagaaacactgggggagagctttgtgcagatctaagggctgaggcacccgctgagagggcttcaccccacctccactgccagctgtgtgctgtcctgggctaccctactgaggaggacagggagccaagttctcagtcatgagaagtaagtgaatgggggcatccggtcatgggggagcctgggtcctgtcaccattcctaggcccgctgaataggagtgtatcttggaaaccgtgcctctttggcagggtgtgtcccagtcaaggtcaagatctgctgggagatgggtggagtcccaagagagttactcttccctggcagcttccttggcagcaatggtaatcaaattattgaggagttcctgacataagttctgaagttctgggaagactgagcatgcccaagggtccaaccctttgatttacaaagagaccaagacccaagaggggagtgcatcactgaagagctcaccattagggcctgggagctggtggagtctggtagacattaggacccacagcttatattccttgttcctagtgaagagtttatctttgtgcctccaactgcaggcactgctgtaccctgaggcaggagtcacagtaaactgaggtcagcaggcagtggggatcagaactcatcatctccctgattccctaaccttaaacacacacacgcacacactcataccagggcctgatggctcagtacaatccagctagggactgctctgtgtgtgctatgtgtatatttgtgtgtgtgtttgcatatgcttcaggtgcagttgatcatctatagcaagaagagatgggagcagaaaaccttggtctcactcctttccctgcttgaaaccatgggcccacagctgctgggcagatgtcaggggccctttaggcttccagctgagcaatgtgggggatccgatcctccctgctcatgtaagggaagccagaggacctctcaaagtctacagtgagtgaggaaaagggaagcctgttaccctgaggcctgaggaagccccagctttaacctggggtctttccacaagccacaaaaggggaggccatactgagtcctggaaaggcccatggactgaaaggctagtgagcaggttctaacacagggtcacctgaggcaagccgctgatctctggtctccagccacaaaataaatgccaagcatgggagtctctgagttctaagagcccaagaccaaagagaccccctcgtcccctaatgggtgaaagagaatagacccctatagtatacaaggtcaagttgggattccacttgcatgcatgggacaggactatagtccttggtgagacaagaggaccaggagaagaaccaaaagtcctaaaatggagtaggagccgtggttcttttctggcttcttcccctccgcagcaaaagctggcagatcgatttcacagaaacagccccaggtcggccgaagcagagggcaacagccccaatagtatctgagggatacacttgggtagctctgcgttttatgcacacatgcacgcgcgcgcgcgcaaacacacacacacacaacacatgcatacacataaatatatccaagttttctgacccctttgaattccagttaccacctacttgggagaggtcagagcagagagggtttaggaccatgacacaccaaagagtgaggccagagaaacaaggaatagatggaatgtaggaaataagcgatgggtttgagggtcaagggggaaggggtccagatggagcactaccaggagagccatagagtaagaagtccagagacgaagggcacaggtcataaagtacagacacgggaggtgggaagggaacatggcagactggagggtgtctcaggaagaaacaaagccccttcgacccctacctcggccagtcaatggtgtatgacatagccatctcactgttaggagctagtcagtgtggaatcagtagacaggaagtctaggaatgggaggtcacatgccagtcctcttccttgaatacagccatgattatgttgagcaacgggccacaaagagctccgagtccccagggtgtgtgtgtgtgtgtgtgtgtgtgtgtgtgtgtgtgtatgtacattcggtagctgattccttccttagcaatgctggaaattgaactcatgccacaggcctttgtggctagcactctcacccaccgagccttctcatgggccttttatttggttttgtttgtgacaaaatgtcatagactggctttgaactccatatacagctgagagtgaccgtgaattcctgatctgcctgcctctgcctcccacgtgctaggattgtaatatagagcatcaggccctgctccatcagccttgttccttccttgtatcaatcactcctgcatctttctcttttcctttcttcccattcctacccagaatcctgactgtcccaggctcaagattctaggatgtgaagatcttcaatctgttccatcgcaatgaatatgtgtcttgataactgctgtccctaccaggggctcacccacccctccctcccctgcctctgttgctgactcaaaccaacagggacagggactttccccatgctgagtgctctctaaggaagacagcctggggtctcactcctgccccgtgattatttcctggggtctaatctccactcctgctgcaatgatgacacggcctcttccctgagactccaaggctcaaagagtggagttctgtttgggagcagaacagaaacaggcagaatttcagtaccacagccaggtcttcctgagtctgcgtccctcccagaggcagagccagagctctggaggcaggcaggcaggcgaggctcccactcctcagagcttcttcctcctggtgattcatccccttcccccatccccggcttgttttctttgcgttcttttatttcctctcctttctccagtcccagactgtgggggtggtgggggcagcaagagggggtttcgagtggctggctggctggcttgctttcttggctttgcaaaacctgtctctccctcgcccacctgagttttagagtcaccagtttttcagttctgatatcaggtatgtcagtagaaaattccatgagggcttgcctggttggggacatgcccagcaggtaaatcagtggttcctgtccctgtggtggcacccaccacctgggtttccagcagaaactggaggaactgagaactaaggaatatgggaggctgatgacaggttgtggcacataggggaccactggctggagctgtggtctcagtgaatagagaaggggcctaagctgagagatgcattttctttctcatccagccattcactcactgatgcaaagaaaggcccaacaaggggcaacctagcccataccctcaaggagctgtggacttccagaggagccctgggtcaggagctctgctggggtgcatgggtcatgtgatcttggctctagagaagtagataaagggtgcatgggccagccaggaccactgagggaagccaggcccaaggaatggtatctgtctgtcggtttatctatctctctacctatctacctatctatgtatcatctatgtctcatctgtctgtctgtctgtctatatctttgtacgaggcatgagtcctggtttattcctcacctagcctatcattacccttgtttcacacttgatcattttgcagccaatgaccttgctctatccgctctcttttagtatacttaggtatctcatcctccaaggggatacagcttaatgattgaggactctgactccagttaccaaaacctgaatgtaaactccttgcttgccttttcctggctgtatagactcggtctaatcactctctaggcctcagtttttgtttttttttaatctgtaaaatggggacaatactaacagaccctactttacagaattgttctgatgattaaaagtatatgtaaagagtcctcaggacaatggaatggtactgcaggaccttgccttgcaatcttggcgacttgaattcaatctccagaacccatgagaaggtaaaaggaaaaaacagatttcacagagttgtcccctgacttccacatgtaagctgtggcatttgtgcccacatgtatatatagcatgcacacatgtagtataataattcataaattatttttttaaaggaagctgagtgtggtggttccataatcccagcacatgggaggctgaagcaggaagatcttgcatttcaggccagcctgagtacgcagtgagaccctgtttaaaagaagggctgggaggcagtggggcagctcagtggggaaaggcattgctgtcaagtttgataacctgagtgcaatgcccaggcctcacatggaagaaggagagcaccaatcctagaagctgtcctctgacctccacacattcaccgtggtgtgtggctcatgtgcaggcataattaataagtgaattaatttagccaggcggtggtggcgcacacctttagtcccagcactcgggaggcagaggcaggcggatttctaagttcgaggccagcctggtctacaaagtgagtgccaggacagccagggctacacagagaaaccctgtctcaaaaaaaaaaaaaaaaatttagttgaggctgggggaatagctgtcctttcactctgctccctttgtgcccatgggctggtgggcagtgacccctgaggaaaggggagacccacacatgagaccttggattgtgtcccacagcacagcacaaaacacacacacacacactgtaaagcctggcatacactaaaaattcaggcagtgtctacatcttttgttattcttccttcttactcagtatcagctggaaagcaggaaaagaggaacagaagagagccctagcatgcctctgcctaaaccattccttccctgaaactggggcttctggagtgagaccctcctgggctgtagcccctctccgttccaaccacttcctctctgtggctaggcacctggtcaggacccagggcccagctctggatatagttaaaatgcactatcaatgaatcttgcagctgtgagcagcgtgagattagaggaggttgggggcagaagtggcttgcttctaccgtatttctcctccctggaggctctaaggtgctccttgaagagcgtttcagggcagaagcaatccaaaggagagtcacttttgctttccagggctgcaacataattatagtttttacatcacatccgtagggaagatgcagagataaactcagtgagctgacctgtataaggaatgggtttgggaagtgattatcaaacctaccttgacatcttgggaggagcagcctggcacaaaagcagccagagactaaaatgtttttatgccaagcatagtctgaaggcaaagaatcactgtcctggagtgcattataagtgtggactttccgagccctgccttgggctgcttgaacaaagatcttcatggtggtggtggtgttgttgttgttgttgttgttgttgttgttgttgttgttttgttcctatattttaacaagacctccaggttctctttttttgaaagacaaaagactagagttgctagctgggtgcctcctgcaccaggcatttctgcttttgtaagaataaagatagaggggtttttttttttttttttccttctttcagtttttagagacagagtttctctgtatagccctggctgtcctggaactcactttgtagaccaggctggcctcgaactcagaaatcctcctgcctctgcctcccgagtgctgggattaaaggtgtatgccaccactgcccggctggttgtcatttttaaaacagggtctcaaactatacgccaggctggcctgaaactcatggcaacccacctgccccagctttctgaatgttgagatttcccagcttgagggttttctttgtgatacccttcaggagaaaggcacaatgagggaacagtaagacacaaaaatcctaagaaagaagcagtttggctgctgtgggagccatggggcttgggctgacctgaaggctcctgacctttgattggctccagttcctggcaccgttgggccctgagatggtaagttcctggcagactaggctcccaggcaacagtttgagtaatcctgtgattactcagcaccccctccccaagcggggttcccatcacctgctgttcagggtctgagtcttgaagctttgctgtggaagatgtttctccgctcctctcatgctgacttccctaccagcccttcccctccttccttccccaagtgtctgtctctctctgactttgtttgtctgtctctgtttgtctctatcttcccaccacacacacacacacacacacacacacacacacacacacacacacaccccactggtactttctttgatatttaagtgtttagggtggatggtactgaacagggtgaaggtgtaggggacggagaactagagaaagtcaagaagtttggtcatgtggaggattgggcacaggaccagaacaagcaggggtttcccacgatttcagttgtctctcctttgctataactattttcccccagtcctgaatctctcagtctccccgtttcttgtgcttgtctcattgtagaccactgctttggattggcaatgggaagatagaagaggggctacgctggtagctagggtccagggctcccatagcccccaaactcccagttcttgactggtcatatctcctatgagatggcagggtcttacttacactgtggtaaggttcctgggttaggaccagcaatgggtcaggtatggggcaggaggtatgactggggtcatccatgcggtcagtgtacacacgcacacggatgtggctcttggagaagggaagaggtagggaggcctgtggttgcctgctaggccagggcctgagttcccaccgtggcttggcctaatctccctaccacttgcttttctgggtgacctatgttggtttccccctctctggtcttagggccactgaagagtgatataccacagagtacagaggagaaggtgttgggtaggagcaaaggctgtggacccaagtgttactgccaggctgccattcccatggatttgctttatctcagacagtaataccctgccctgtagtgctctgcctctccacggtgctccctgtactctcttgaatcatgccatgtgacctacaccacaggcaatgttgctttcaccgtcatttgctgccaagggaactgaggttgagagtgactggaagtgtgtgtgcccccacattttccacctctcttccaggcactcaggtcccctcctgttctctcttccccaccaagcatttaacccagcttgtaacttacaggaagccattgaacagagcatttgatacctggtggctggagcttactgtgcagttggcaggtagaaagtatgtctggaggtaggacaaagaactgagttttaatggaaggatttcaggcactcatatggccaatcccttaaagagacagctacttaatctgacccagctctgggctggcttgagaaggtcatagtttaaggatgatggaatactttgggaagtgatgggcaaatcatggtctaaccattccatatcagcagacctatgtgtggttatagattttggacatctcacatagccctggttagccttgaactcatgatgtagccaaggacaatatagaactcttgattgtcttgcttctacctcttaaatgctggaattacagagacgtagcagctctcatatgacagatgctaggcacaggctggacatgagatcctatgtgagtttgctctccatgaggcacttcctctgtccctagggtgggagacaggtcacagatgagatgggactgttactctagatctcttttctagcctgcttcaactctcgactatccactcaggaaaatccagaagtcagtcagtgattgggagaagagccagctcccccactcccaccctacccctttcgccccctagtctttggacttgttgatgaaaagatctggggtggctggaaccccaagctttacctagctgctgtcccttctccctcccaggtccccaaagaactgcagattgaacctggggcttcatgcatgctgctttaccacagagctaagtcctagctctttttcagttttttgtttgtttgtttgtttgtttgtttttcaagacaggctttctctgtgtagccctggctatcctggaactcaatttgcagaccaggctggccacaaactcactgagatccatctacctctgcctcctgactggtgagataaaaggtatgtgccaccactgttgccttggactttagtgtccaggaatcaagctctaaccaacaaatgtgtgtatgtgcactggtatagacaatataccgccaatccacaggccacagagaccaacctaccttcttttctccttccttccttccttccttccttccttccttccttccttccttccttccttcttcttgagcagtcctggctagcctggatcttgatatgtagatcaggcaagtcttgaactcaaagtaatctacctacctctgcctggctagtcctaggattaaaggctggcctcaaactgacatcatttcaacaagccacatatacttttcttctgtgcacacacacacacacacactcaagtatgcctccaaacatgtcaagaagataacagataatgaactgttcaagagagtggggttgtagacctggcactcaaagaaactagctgtgtgagcctgtgctaggtagttaggtcttcatctgtgagaagaacaggtggatggagtgtgctttaatctcagccagttttaacagtcgtgtcctgtgctcatacacatagacccagatgcctttgtacatcctcttacacacttacacagagcattgcctcgtcttggttctggggtcatcagtctagaaatcttatttgggctttaagacaatcagcaaagttgggttgagcccttctctagatttcatctgtttctttctagtctctctgtacctgctgtgttggttcccctcagttcctgtccctgtgtagccttcactttcctccaagagtgactaacatctctgtctagtgctcagtggctgtgccccatactctgttctgggagccaaacttcaatggggggaaggagacaaaatagaagccccctgggcgggaagcaggtgttacgaagcagtaaggcctcctctggccctatacaggatgagaggagggcactgaagatgttcaacttgaaggactgagcaggtggcctctttgcagctgctctctgtctccataaaagctgatacaactcccagctgctttgtgaacaaaacacagcctcctcagaccctatgctgagaatcatttacactttacttccccttccataatgcaagagggcgtgttggagctcactgaagaagtggggggagcaccatacacctgcgtctgcagcccaggctcatggtagtgaaatccagaaaaaaacattatgggctagcttctctttctctcttccagcacaaattgaagtgatcccttgcaagatctgtggggacaagtcatctgggatccactacggggttatcacctgtgaggggtgcaaggtgagttgtacatatttgtctgcatacatgcacttggctgtttcagcggtctccccagggtcaggaacaggagggaggaggaggacctaatctcgatgtaggaatgtgatcacagggtccatcacaattatacagtggaggttcggggactttggtggatgtagaaattcttgagaccagtgcacatgaattggaggtccctgggaccacctcaaactccgagagggtgggataagtccagaaaacctttaccagcatcatcttagtactcttgtcccttcttcctctaatgagttctcttcattcttctttctcctggcctagttcctatccagttcccacactgttacctcctgccttgtttagctccatctccctcctgagtaactatccttaggcataggattgtggcaaggaacaccgtctgggttggcttgagaatgacccagaaggtgggggatcgagtgtggtgttcctcgagccgtatccacctcccttcacccacctcctcacccaccgtcttcaccacaggaggagccctgggtggagtggggggcatgaggtgaggaagacccagaaggagcctgtcagcacttttcagtgctcaaaataacaaagccaaagcgaaaggaaacatgcaggggtgcaaaggggcaggcggggcgaagggctgtgcccccacacctgggaggggttgggggagtgaaaaggcaggaaagagagagcagaagaggatgttcagaagcaagccaccagagcctgggttgggctgtggtgagtatctaggtcaccagggagcctgcaggcctgaccacagggaaacctgtgttcgcagcccttctcttcctccagccctcccagacaggcaagctgaccccaatacagcctgaggccccttactcaacccccacctcagccctagtctcaggagactcgactccccggcccaagcccattgcttgagttctgcactattagcatctagtctagagctgaaagcattttgctggggagatggaaatgctggtggaaccgatcctaaagagagcagagccaggcatgaaaggagcctggagcctaagctccccaaaagaaagctcatagacagagctggggaaatggagcatggagtcagattcatgtgcctgttgccctgtcctgtcttgtcttctcttacctcctgtactgattcctgaaccttcttcagctgtcaagtttggccgaatgtccaagaagcagagggacagtctacatgcagaagtgcagaaacaactgcaacagcagcagcaacaggaacaagtggccaagactcctccagctgggagccgcggagcagacacacttacatacactttagggctctcagatgggcagctaccactgggcgcctcacctgacctacccgaggcctctgcttgtccccctggcctcctgagagcctcaggctctggcccaccatattccaataccttggccaaaacagaggtccagggggcctcctgccaccttgagtatagtccagaacgaggcaaagctgaaggcagagacagcatctatagcactgacggccaacttactcttggaagatgtggacttcgttttgaggaaaccaggcatcctgaacttggggaaccagaacagggtccagacagccactgcattcccagtttctgcagtgccccagaggtaccatatgcctctctgacagacataggtgagcatctgggaagggtgggggcagtgaaaatgagacaagaacttcctccagcacggtgcccatgtaatcaagcattagtcctaaggaattagggatcctggacaaaaagccaagggaggaggcagagcaagggaggccaggcagagggcctctttatgaactttggggtgggaactggctgatatctagctgtgacttcatcttctggccccagagtacctggtacagaatgtctgcaagtccttccgagagacatgccagctgcgactggaggaccttctacggcagcgcaccaacctcttttcacgggaggaggtgaccagctaccagaggaaggtaagggcaagagacatgagggaagggagggcaccaccacacgcgggtgcggtgcgggcgcgcgcgcgcgcacacacacacacacactggtagagcccagatatggcgtctttcacaggaatgggggtagcaatagggtatcacaggctggctaacaggtgtgactgtctgtatccaggcagcaagatgactatttctgtagctcctgcttattgagatttcacctagttagcaacctacatcctcttccacccagaccttgccacactgcctttcatcctccatcagtaactgatgctaatcagtatctgagggtcatttactggacaccctttcctgtcaggcattgtaatagaagctttgaattgtgttcaacctgctgtttgtgaactacaagtgtctaaagatagtgataaatgtggcccaatgcaaaatcatgagaatgtttttggttggttgattggttggttggttggttggttggttggttgttggttggatgttgttggttatttggttgtggttggttgttggttgttggttggttggttggttggttggttggttgattggttgttggttagtttggctggttccaagacaaggttttgctgtgtagccctggctgtacctggaacttacttggtagaccaggctggctggacagggtctctcatagtctagcccggcctatgagtgacctaggtctgctgagtcccaagagatgatttgcctatctccacatctcaaatgttgagattataaacatgtactaccttgtctggcctctctctccctctctctctctctctctctctctctctctctctctctctctctctctctccttccctccctccctccttccttttccttttccttttccttttccttcttcttctttcttgtttttttttttcttttgggtttttgagacagggtttctctgtgtatccctggctgtcctgaaacttactctgtagaccaagctggccttaaacttagagatctgcttgtctctgcctcccaaatactgagatcaaagtcttgtgccaccacatccagttttcacctggttttctttccgtgggttctgggatctgcattcaggccttcatgcctgaaggccagcacgttgttgaccttcatggtacttttggtaaatgtgaggtcagaagctggggtagactgataaagcagaagagtagcagaaggcagcctggaaaccgctggaggaagagcagttaggaaggctttcagtgccgtatgaagagtgaaagcctcacttctaggcaatgctgtactcagagctgcttagggaatttccttctgacctgtgtgaaggatccatctatgtaaccgttcgctcaggcccttgttattcacagtcatcacaggagtcctgagatacagaaatcacttcaaacagtctctccctgaggaatgtaaactttaatctacaacaaaatggatttaaagaaggtctgggaaagcagttggaatacaaatgtggttggatccactttggtgccttttgttctgggtttttgaggcagtttcatgaagccaaaggtagccttaaactcatgatcctcctgcctccagctcctaagtgctgagatcacagccatgtaccactttgcccggcagaatccactttcaaaatatatcacgtgtcccatgatgtgccccccccccatccagctatcagccacaattggactattatactcctaactcaatcccaccccatctttgtctgccacgtcagagccacacagcacttgctcagtaaccaccctggtcattttaaggagacaagacaaaacctgcctcttttgatctccagcctcctattttagccaaaatccaactccagagtccatgttacagtcaaatggaccaccctgccttcctcctcacctgacgttgcaccatcctttgactcccctactctgaccacagtattttttcactggtcccatctctctggggcctcttatacctgctattgtctcctgtcatattctcttccctgtttccaagtattttctccaggccttcattcaagagaggttttccttaaacagttaccggactggagaaggaccccatcccttatcctgctttagtatcagatacaatcatatgctgcttactaacaggaatatgttctaagaaatgcttacccatagcttcacatggtggggtacaactggatatacttaatacaaacaaacacagctgtactgtcgtccatactcccttagccttatgggaccactgaagtttgaggttcataattccccgaaaagttgttaggcggtacgtaactgtgtttatgactccctggctgctgtgcacatttaataaaagcacatctttttattcaccgatgttacaccagagctcatgacagtgcctcatctagatttatggagtttctcaacaaatatcttttgaatgaataaaagaaactattgtagtaacccaggcaaactcaaagtactaaaacacaaaataaattcaagaggcgtaagggactcactctgctacctacttttctgattgttactttttctaaggaactaagctaagaaggggagatgtcaagaaagagtggtttttaagtctcagttcattatgctgtaaattgcgtaggagagatggtgcctggggtctttctccctgcctctgtcccctgggcttctgcacctttcttagaggtttaccttcctttggctggaggcttactatactgacttactacctgctgagttaggcaccttcctagaaactgtttagttaaaacaagcaggtgatgaacatgaattcagcattcatgccagggacagaagatacatagtggcaaaaagacagatggactttatctaagtacatgtggggcaggaaggcagacagactggatccttttttctacagtgtggcaaatgctacacaaagggaagccaacaggacttttgcccagcaagggatggggatgatattctcagaggagataacacttgaattagcaaaataagagttagcagagcctcaccctccagatgaagaaacaacatgaaccaaggcaaagggccatgggagcaaacacaattcattctggggtaggcagagccattgatgccatcattcaagcatgtccttgctccaagcacagtcctgaaggtacagaaatgaccatcaaaattgaacctaggaaaagctcacctgtctcgtgtcagttctaacttagcctgaggtttccagatatgcatacatctaacaaatgggattggctgctcaagttgggtcaagggtcggggaggcatcaagaagggtcatcctagctcagtaacagtgagatgtgtttgctctgctaagcaccgaagtactcattccctcctaacctatcctcagctgccacccaaaggaaaactccggagcctgtgcagccaacatgtggaaaagctgcagatcttccagcacctccaccccatcgtggtccaagccgccttccctccactctataaggaactcttcagcactgatgttgaatcccctgaggggctgtcaaagtgatctggaggaaggacaacctgaggttttaattcatacaggacaccagaattcatcccagctccagctgtcctctgtccctaagagaagcagaggaccggatactaaccagccggaaaacccaaggaccagcacccgggaagatgcccttgacttcagtctttacgctatgaggaaggaaggcagcgccatcccctgctctgtacctgtgtgctgctgactccacatgatggagagactaggaacaggacagggacctgtttctcctccatagtcttgctcagaatttctctcagttttgtaaagctgcagactctcctaggaggtataagcagcagatgagagggagggaggttttttttttttttttttttttttttctctcagaggaagggtttagccaagtaaacataaatcccaacttgtgccattctttataaaacgatttcaaaggctggaagtgtatcgtgcctgcgtgcttgtacaagggtgcagggcacacatgtcgggtgttgggagacttgaatgtgactgcctaggatacatgcttgccctgcagttttgtttctgtgtcaagccagcaatttatctgttttataagaattttagcacacacacatacacacacacaccgcccaagattctccctcagctaagcaatccaccagggagactggtgctcagatacctgacacaagagaaatggcaagctaaactgaaggaaggtattctagactaagaacttccaacaaatgatacccacaggcccgtttagatttagaaattgcacagaattgccctgcatctaaaagactagaggctgtggaagcggtgtcccgggagctctctagctccccaggaggaaccaggatgtcaaaactctctcaagcttcccaggctgtctccgtagcagaccctgccccagccctgggtcccctcttcagttcctcccccgattcgattcgtcatcccgtagtggcgcttgctgcagccctccctggttgctttatttatttattttgcaccaacagggttgctgcagactcattctggtttaaaaagagagaagaggagggaaaaaaaaaaaaaaagaaaaaaatgcttcctggctcttttctctcctttggtcttggcagcgcgaccgcagtagcggcggcagcaacagcagtcttgccagccggctgatgcggcaggctgccgggcagtggggagtggggactcagacacacggggaaggtggagaggccaaggtgcagctcggatgggacaggccccagccctggagagatgcagcgcccaacttgatgccaccccccagcttctccggtaagtgcccctgcccctctgtgggcacgtctcagctgccctttcccatggcattctcaaagacaaggccatgttaaatagcctacaggaaagagagcttcccctctaccctagctgaccattcatcctgtgattggaaaactaaaatgtcccaggtacccctggtagggagagtccaaggagccccccccccccgctttttttagcctctaaaaagctgccctcctaatctgtgtggatactccaaaaatctctctcctaagtgccccttcaccatgcaggtccccatgcctcaatctggcatgctttaaagtggatatgtgctcgaatgaatctgtggctgccacatagacaagaaagctccatctccctgagggggcagtgccccagactctagaccccaggggaagagaaagagtt

SEQ ID NO: 1554 - DNA, 2893 bp, Mus musculus
gacgggccaggtgctccctccctcttccctcctccctcccttgggccctgctccctgccctcctgggcagccagggcagcaaggacggcaccaagggagctaccccatggacagggccccacagagacaccaccggacatctcgggagctgctggctgcaaagaagacccacacctcacaaattgaagtgatcccttgcaagatctgtggggacaagtcatctgggatccactacggggttatcacctgtgaggggtgcaagggcttcttccgccgcagccagcagtgtaatgtggcctactcctgcacgcgtcagcagaactgccccattgaccgaaccagccgcaaccgatgccagcattgccgcctgcagaagtgcctggctctgggcatgtcccgagatgctgtcaagtttggccgaatgtccaagaagcagagggacagtctacatgcagaagtgcagaaacaactgcaacagcagcagcaacaggaacaagtggccaagactcctccagctgggagccgcggagcagacacacttacatacactttagggctctcagatgggcagctaccactgggcgcctcacctgacctacccgaggcctctgcttgtccccctggcctcctgagagcctcaggctctggcccaccatattccaataccttggccaaaacagaggtccagggggcctcctgccaccttgagtatagtccagaacgaggcaaagctgaaggcagagacagcatctatagcactgacggccaacttactcttggaagatgtggacttcgttttgaggaaaccaggcatcctgaacttggggaaccagaacagggtccagacagccactgcattcccagtttctgcagtgccccagaggtaccatatgcctctctgacagacatagagtacctggtacagaatgtctgcaagtccttccgagagacatgccagctgcgactggaggaccttctacggcagcgcaccaacctcttttcacgggaggaggtgaccagctaccagaggaagtcaatgtgggagatgtgggagcgctgtgcccaccacctcactgaggccattcagtatgtggtggagtttgccaagcggctttcaggcttcatggagctctgccagaatgaccagatcatactactgacagcaggagcaatggaagtcgtcctagtcagaatgtgcagggcctacaatgccaacaaccacacagtcttttttgaaggcaaatacggtggtgtggagctgtttcgagccttgggctgcagcgagctcatcagctccatatttgacttttcccacttcctcagcgccctgtgtttttctgaggatgagattgccctctacacggccctggttctcatcaatgccaaccgtcctgggctccaagagaagaggagagtggaacatctgcaatacaatttggaactggctttccatcatcatctctgcaagactcatcgacaaggcctcctagccaagctgccacccaaaggaaaactccggagcctgtgcagccaacatgtggaaaagctgcagatcttccagcacctccaccccatcgtggtccaagccgccttcccgccactctataaggaactcttcagcactgatgttgaatcccctgaggggctgtcaaagtgatctggaggaaggacaactttctatttccttcagccctctgacccgtctccctggactcccttcacccagcctttccctttctgcactctatgaagggtggtatccctaggagtaagcaaatcctaagactgattttctgcccctaggcttgccttgtaggacaacagcagcaagtgatggagaaaaggcttgttatgtttgatttcccataagttccaccctggcttctggaagctgtggggtagatgggatagagataggatgaccaagtcaaataaaaaacagactgacaatcagcagggataaatccaggtacctgggataaggagaactcaaatctaggcttgaaagctaataacagtcctttcaatacctcattgtatttccccatgggtcctcctggggggacatggatctagctcagagactggtggcaagcccccagaaggacctgtatataataagaatatagattcctgagacttttctgcctttcttcttcctagttaagaaatgttgttgaccccctctgcctgttttctgggacctaaaatgcctggatgtgtaaagaatgagggtggggtggagataaggtcccaagataactgttttatggggtttgggtatgaagaaaaacatcactggaaaaattagaatggaaacctctttgcacactttaaaagtgtcagattcgttagcagtctaatcagagacacacatccacacaggtggagcacacagaggctctgcccccagtgacaccattctgtagactttccctctggcacacaatctcttccttgaggttgcagctctgagaagcctgaggttctaattcatacaggacaccagaattcatcccagctccagctgtcctctgtccctaagagaagcagaggaccggatactaaccagccggaaaacccaaggaccagcacccgggaagatgcccttgacttcagtctctacgctatgaggaaggaaggcagcgccatcccctgctctgtacctgtgtgctgctgactccacatgatggagagactaggaacaggacagggacctgtttctcctccatagtcttgctcagaatttctctcagttttgtaaagctgcagactctcctaggaggtataagcagcagatgagagggagggaggttttttttttttttttttttttttttctctcagaggaagggtttagccaagtaaacataaatcccaacttgtgccattc

SEQ ID NO: 1555 - DNA, 1551 bp, Mus musculus
atggacagggccccacagagacaccaccggacatctcgggagctgctggctgcaaagaagacccacacctcacaaattgaagtgatcccttgcaagatctgtggggacaagtcatctgggatccactacggggttatcacctgtgaggggtgcaagggcttcttccgccgcagccagcagtgtaatgtggcctactcctgcacgcgtcagcagaactgccccattgaccgaaccagccgcaaccgatgccagcattgccgcctgcagaagtgcctggctctgggcatgtcccgagatgctgtcaagtttggccgaatgtccaagaagcagagggacagtctacatgcagaagtgcagaaacaactgcaacagcagcagcaacaggaacaagtggccaagactcctccagctgggagccgcggagcagacacacttacatacactttagggctctcagatgggcagctaccactgggcgcctcacctgacctacccgaggcctctgcttgtccccctggcctcctgagagcctcaggctctggcccaccatattccaataccttggccaaaacagaggtccagggggcctcctgccaccttgagtatagtccagaacgaggcaaagctgaaggcagagacagcatctatagcactgacggccaacttactcttggaagatgtggacttcgttttgaggaaaccaggcatcctgaacttggggaaccagaacagggtccagacagccactgcattcccagtttctgcagtgccccagaggtaccatatgcctctctgacagacatagagtacctggtacagaatgtctgcaagtccttccgagagacatgccagctgcgactggaggaccttctacggcagcgcaccaacctcttttcacgggaggaggtgaccagctaccagaggaagtcaatgtgggagatgtgggagcgctgtgcccaccacctcactgaggccattcagtatgtggtggagtttgccaagcggctttcaggcttcatggagctctgccagaatgaccagatcatactactgacagcaggagcaatggaagtcgtcctagtcagaatgtgcagggcctacaatgccaacaaccacacagtcttttttgaaggcaaatacggtggtgtggagctgtttcgagccttgggctgcagcgagctcatcagctccatatttgacttttcccacttcctcagcgccctgtgtttttctgaggatgagattgccctctacacggccctggttctcatcaatgccaaccgtcctgggctccaagagaagaggagagtggaacatctgcaatacaatttggaactggctttccatcatcatctctgcaagactcatcgacaaggcctcctagccaagctgccacccaaaggaaaactccggagcctgtgcagccaacatgtggaaaagctgcagatcttccagcacctccaccccatcgtggtccaagccgccttcccgccactctataaggaactcttcagcactgatgttgaatcccctgaggggctgtcaaagtga

SEQ ID NO: 1556 - DNA, 44577 bp, Homo sapiens
cttctggacttcttattatggaagtcaagtgtccatattgttaagtcagactgagttgggttttctgttttctcacacttttagcggatgtcagcctaaatgatgcccacgtgttatctttaatcctcataccaactctgagagttttattctttctgttttccagatggaaaaggtaagccccaaagagattaagttacatgctagaggtcacacagctagtcagtcgcagaatccagattcccagcccatctgactgatgacaaagcaatgaatactgcagcactccaagaacatggaccctccccagaaacaacaccagggctgagctgagtcagaagccacatgaatggaaggtctggaggccaccagggatcgccacagaagaaacacttgctttgttaaaatcttcaagtattagatgacacaataatcattgcattcactggtttgtttcatcttttttcctgcatttcaggatttgtcttattgttgtttgcatgtttattgtctgtctctccccttagacagctctctattctatgtatccccctagcacagtgcctggtgcattttaggcacttcaatgaatggatgaacaaattgattcaagtataattttgcttactacttcactcatcaaatacatcctgactgagtacctgctttgcaccaagcactgtttttaagattcttagtctagtaagagaggtggacattaaacaaataaccacataaatagagggggaaaaactgtaatcaatgctataaaggaaaagtatgaggtactatgaaagtgtacagcaggtgcccctaatttagatgggagggtgtcagtgagggcctccagagctgaagcatgaaggagaagagtggtcctaggggaggaactagccttgcttcctttcagagactgaaggatggtaggtgtgtctagactgcaactgatggtctcatcttgtctgtggtggcctgtgcttcctaagatctgtcagggatggaggacataggccagcttgatcctgactgttggatccagctttatcttcagtgtttctaagtccagaaatcctgagtctggccacttttcctttagccacaataattcagagaactattagccagaataatgcagacaactgatcactgcaagtcactctgccttggagctattggaatggctccagaacagggcactgggggccaaggcaggatttcaaccaggagggttttacagaagatggacttcacctgtgagggctggggttggaaccgagcaccaaagaagtggccactgtccactgatggccgtctccctcttctctgtagccctcccccacccctaagcagcccagcttcagcagaggaggcctgggcacaggaatggattgttgctagaaacctggcttcagctggaggaagtcagaagaccgggctgatggccgcgcagacagagctgtgtttatccaggaaaagaggtaggacgtaggcagcggaggcccctgccagctcctcccataaggactgcgctgggggagcaagctgcagagaaagctgctcccctctggctctgaaagtgtcagggcctgaggccagaacccaaaagcgacccacaggtgaggccagcactccgggcgcgcgacggagagggtcgctagctcggatcccagggcagagggtcggaacacggtgctcttggtggctccgcgcaggggtgaggcgagcgcgtggtggcggagccttccggagaccgctctgagggtggcggagaatcaatgctgcctttgtgctcggtggtttccgagggagaaaaggagtggagagtaggaggggcgacccaacggcccggccccgccctgcagacgcgggatgcggtagggctgggaggcgcgggagctggacggtcagggctactgggggtgggattctgtgtccccgggaggtgcgtctccttggaccagcccagggtgtcctgaggtcagcagccaggtgtgtcccctggctgccaggagcagaagtgagtcctcttctggcttggagcgactcgaggaggggaaggaggagccagaggaggcaggtggggctaggactgagggatggctcaggccagagaagcttgagccggggcagcctggcaaagggaggaagtcccaaggggcgccagactggatcccagaggaaaacccaagtcttcgaaatgggcgggggaggagggcgtgagcccgcctagggcgcagtgtcccaggggggttgggatctgagtccttttgctataatgcggttattatcctatttgtcctaatagtaccctagggttctggtggatactatatgggccctctaactgtaaggtgaatggggcatctttagtaccagtgggagaatctgtgtacttggtgacggaggcccgtatatgaaaatgtgactgactggccctttgctccctccatttctccccagccccccagactgcgccgccctttctttttctgctcaaataggggtccgcgctcccagtgggtccggagaccggggcgcggtggctgaccgcccggtgtacgccagcatcactcacctctgactcctctgcgctcctcgcccagccccgctccgccgagcactcccatctgagacgggatttggaccctctcggccctgcggaattcggaattccattaccccacccaccgcatgtggctcttggaaaaagctggctataaggtgggggccgcggatcctgcggcccgttgggcgccttccggcctgttctccaagcgtcgcgccccgggcccgcccacaagcgcctgccccaacgtcctcaccccggatcgcatcccgcagttcttcatcccgcctcggctcccggacccgggcggcgcattgcccgcggcccggcggcacgtggcggggcgcggcactccccgcgacctgttcgctgcctcacctggcgggccgcgaatgctgggccttcctgcccgagagcccgcacacgcgccggcgggaatccctgttccacgggccgccacctgccccggccgggggactccccgcggcgcagtcccggctgcacgtctccgccccggacctgcgcctctgccgggcccccgacagcgacacggcctcgtcgccggactcgtcgcccttcggctccccgcggccaggcctgggccggcgccgggtgtccaggcctcactctctgtccccagaaaaagcgagctcggccgataccagcccgcactcgccgcgccgcgccgggccgcccacgccgccgctcttccacctggacttcctgtgctgccagctgcggcccacgcgcgagagcgtgctgcgcctggggccccgcggcgggcagctgcggctctccaccgaatatcaggccgggcccgggcggctgcggctgcgcctagtgagcgccgagggcctgccccggccgcggtcccgccccgggagcggcggcggacgaggatttttttttcgacgggctcggccccccggacctggccgcccgcagcctgagagccaaggtgctagacaggggcgcgggacttcgcagggatgtgctgctgggggagtgcgagacgcccctcattgcgctgctgcccccgctgggtgggggactaggtcccgggtcatccctggcgcccacccatctcagcctgtagcctgagcccctggcttcctcaggacgtctccactgtgtctgcagtccacattctttccaccctgcccggcttgtatttatttttgctaataaaatgtccccttgtccttagccagatatttccccttactggcaccttacacgctcgggcatagagcctaccgatcttccctctatcccggccatacgcggggggaagatgctcattcagacggtctgagtagagcagaccttaagcagtggttctcaagcttgaaggagcatcagaataaccagacatcagaaatcctggaagagctttttaaatatgcagggtcctgggctccatccccatgagatgctccttcagtagatctgggccaagtaggtcctaaggtccccggccaacaaggcccccgaacaatcagggagccctgcaatcactgagtcactctgacagaaaccaacacaagccaccttccacttgaggctgcacagaggaaattaacactcccttcctgtgcccctctaaaacccacatctgtcctgaagacagatgaaatttctggctcttgagagtgagtcaggggatgtcagatgaacacagagtgccctttagtcttccttcttccctcttgcctcttccacacctgtgcgtcccttgaggggtggggcaagtctggagccaagaaccagagaggtgcttgggtaccaaatgaatgagatataatgtcccagggattgaaaggggggaggtggggtactaccaaagtgtgagaactgttctcaggaatgccagaagagcctcctccagccagaaggaggtgggggtggggggaggtggataattgtaggtcacattgtgtttacctctacctgaatgtccctgacgtcagcagtgaccttcttctctctccctccaccttcccaggagccggttcctctggactcaggccaggcttggaggagggagggaggaagtgaggtaggcactaggctaacccaacttctttctccctctcccttgggccctttctcatttttcatggtgccagctgtggcctgcaccagggctaagcttgcgggatctgacaaaacctcaaaagcctcagcacctggacacgttaaattccaacacacacacacacacacacacacacacagagacacacacacagagacacacacacacacacacacacacacacacacacacacacacacacggcttcattcagacagctctccagttccttctcccttccctgattgggtccgcaccacccagccctaggccagagaactcttgctccaggtgtccaccaggtggtggcattgaccaaacaatcctaagtgctaactactacacatggattataaccacatgaggaactgttccaacaattagtcaagccatttattcctcccagcaccttctattagggtgtaaatactattattatccaatgggatcttgggcctcgcatagctagtaaagggaagaactaggactcacatagctagtaaagggaagaattcagggagtctggctccagagtctggactcttaatcacttcaagataataccccccactgccagctgctgcctcccaatcaagtcactctaaaaggggcctccttccctaagatggtagctctgcaaaggtttcgtaccctgccagtttaaaatcccatgtttgaattctgggaagtctacctatagatttaggtctacccctagtactggatttctatttcagcccccaaattctcccataacaacccttggtgagaaactggatttgatgcccatttgaaagtatctggaaagaaagttagaggccgtagaaccttcattcatgcattccttcaacaaatacttcgggaaggtccatcaggtggcaggcattggatacagcagtgattaaacagacatggggatcagaaaagtgataaaataagccattaaaatgtaaagaatgctacttggtgatatgttacagagaaaaataaagcaagaaagggaatagaaaagaggggtcagataaagagaagggaagattatagggacagaaagagggagggaggagaggaaactttttttttttaaccatagtactttggaccaggtcctgaactttatctgtgttatctcagttgatcatcacaaccactcagtagagtagatattagtattcctctttttttggggtggggggacggagtctcactctgttgcccaggctggagtgcggtggtgcgatctcgtctcactgcaatctccacctcccaggttcaagtgattctcctgcctcagcctcccgagtagctgccactacaggcgcgtgccaccacacccgctggttttttgtatttttagtagagacggggtttcaccgtgttagccaggatggtctcgatctcctgatttggtctcatgatctcggtctcggtctcatgatccacccacctcggcctcccaaagtgctgggattacaggcgtaagccaccgcgtcacaaccactcaggagagtaggtattattattcccactttacaaagaaagaaatggatcagatagataggttaagtaagcttgcctggggaacagccctggctggagggaaaggttctgacctgactccacccagacacccccactgccaccccaactgcttaggggaagctgtgaggaaatccaaggccactcctcccaggagcagttcactcagcattcacagccctgaggctctgtgatgggggccctagcattgctggaggaacatcctgggtagctaaagtacagaaacatgggagtgaggaggtcctaagaaaccctccagtgtgcagattgctctggccccaaagcacttctataaacactagtcagaggccaggtgtggtggctcacgactgtaatcctaacactttgataagtggataaatgtgggaggctgaggcgggcagattacctgagctcaggagtttgagaccagcctgggcaacatggtgaaaccccatctctacaaaaaatgcaaaaattagttgcatgtggtggcatgcacttgtagtcccaactacttggggggctgaagcaggaggacctcttgaacccaggaggtcaagcctgcagtaagctgagatcacgccactgcactccagcctgggtgacaaagtgagaccttgtctcaaaaacaaaacaaaacaaaaaaatccactagttaggacaggtattattgccccatttttactgatgtggtagctgagggctgagatttccctcagggcctacagctagtaaatggcagaccacattcttataagtgattctgccccagcatttaaacccttcttgccacctccaagcctgtgtgactataaatgttaattggtagaggagaggtacaagcagggtcactgtggaaagttcaaggccaggagctagggtcaaactcccactgttcctccacccacagtggcctttgtgacaagaagggggaggggtggggactgtgagatctggaggctaccgaaggttacagagcctgggctgtcctttttcaacggttgaggcacaacccatccctgagtcactccagtgggttgaggcgtccccaggcatggaaccccctagaacccaaagaaaagtggtccctaatcactggatcaggcatcccaaggagagggccctccaaggatggggctggggaagtgtgtgccaccgcagactacccaggctccacatattttccaccttgacccccaggccctccctgaaagggcagatttgtgctgagctttaagtggtttctgtggtttagggttggggaaggaaggaaagagatgctggggactgctccccagttccaagccaccaccaccacctcccatcccttccagagtgtttgcccccagcatggagatttccccaataaggggactgggcacgtggggatgaaatgattctctgatccctatcagccccttccttatataagattgtatttgaagaggaaataaccaccgccctgctttgaaaggacgattcttccagataaggggctgtgattgcagcaagagggagaaagtttagacaagagggggaacttcccaaaaggataaccaagggatcttcttgccctggggagaaaaaaaactcaaactatccatgcttagggcaggggagaggtagagaatgcctaggaagcatgtgacactcctaggcctagaggtcaggatactgtcttctaaatctccagtcacttcctccccaccctacatagtagcacaaagtggcacaactggggagtcagctgtgcctgcagtgtctggggatgctctgtgtccatccgcaagcattctacgtgacctccactctgtgcctgcaattggtgggttgtagaagaggtagtcacgaagggcccctgggagacccagagtcaagaggaagagaggcctaaaaaggagaaaagatagagaggggacagctggagaagagccacagacaggcaggagccagcaaagagagacagagagatgggggataactgaggagttctggggaggaggggagcagaacggcatctcccctgcactcccacgcccggcatgttgctggctcctcctgtcagctggagggtgctgggggggcgggggggaagggagctgcaaagcactttacctctcactccaaacctgcccaaggtgcagagcccccaaacagaccaacatcctgttctgtgcagagatgcatacatggatgcgtgggcccacatttaccaaaagaacacgggggataatcagagcctcagaggcataggcacatacccttagactcagtgcagaaggtccccaaaacttcccctcctctttctcactactcatccactgtcaatgaccctaggagttgaaaagtccttctccacttctacctttatctctcaatctgcagccatggggagactctgggagctacctaagaacagaggtgctgatggtagcagagtgtgaagctccagggttgggcaggagtggaggatggcgagacgagacggcagaagagggaagggacagctgcttgccctctccatgccaggtgccacgtgcaccaggtgggggggagtgggcgagtcacgaggctgtggcatggctgactcctgctctgctgtttaccagctgggaacgagagcaggaggaggtgccagggagcctcttgctgcagcctggcccctggccagttgcttgttgggtaaccaggagagtcaggcccagctaatcaaactctgggcccaggccatgcaggagaaaagcagcaccaggatccccagaagcctcgtcctcttggcccccttcagagccttcactgcaggcctcagtgtgggccactaggtctgggagcctctccttctcccaatgagtccagtgcagcatctctcctctcctcttccccaccatggcttctctgcctccaggcactcctccaggcctgccccttgccccaacagatgaggagcacgtagaagcatcagggggtcagggagtcctggcaagagcagcaagggttaggggcaggggccgagcaggcagaggcctcagggaactgaacagtcactgggaggagtctgactgcatcctagagaagagacacagtcccccaaacctgccctctccatctcccctatgcctgtcacctgtcttaggtagaaatcacaggattctaaagtcacaaagacttgggtccaaatcatagctcacccatttattgttcttgtgtgagtccttgggcaaaatcattaatatctctgagaatccctccactcactgatcaatctggaataataatgtttccctgtggtgggtgctgtgaatatttacacaaagtaaaagcatggatttacataaagtgtcctgcaaagggcccagcacacagtaagtgattaataaatgctagttcccttcctttctcctgtcctgtttctcctcaaggctccatgcactggtccactggtctctcctcatgtcccctcctggtgccaggacactctgccagccactccttttccctgcctgctggagggccaggtgctcccgccttccaccctccgccctcctccctcccctgggccctgctccctgccctcctgggcagccagggcagccaggacggcaccaagggagctgccccatggacagggccccacagagacagcaccgagcctcacggggtaagaggcccatggccctgcctgcaggtggaagagactgctggaggttcagaggagggcagaaatggcaagagactgggcaagaagtgaggaggggagggagggacaagagtgcagaggagaaagccctgggttggcagggagtgaaactggaggagaaacaggaggaggggctggggagatgacagaggagaagaaatcgcaaaaggagagaaacaggaaagaaagggagaagcgggagaaggaagaaacaggttggagggtagatggggagggaagagccaagtcaggggagccagatctagacccagcgaggggtcagaatgtggacaggccctcccaggtgtgggcttaccccccaggaggcacagggacactgcttccttgatctggccaggaccccagacagcagtggccgggaggctggctgctccacgttctgttcattcaccagtggagaaacctgtcctttaaggagtgacagacttggggagtgtggcagggggaaccacaccctgtcagctgcccatgaccacgtagcctggtcctttcctcgccactcacccagggatgtgggatttcatctctgcagagaatgtggggcactgggccatcagcagggaaggacagaatgtcaggccgtccttggccccacccatggtccaagtcaggaaccccctcagagcaggatcgcagggccacaggcttggtcagctgtgagcatggaggaggaaagtttgagggccagagccaccaagctccagggccacctggtggaggaagaactggctgcctgggtgagcaaggggagcacccccaccacaggactgctctgaggtgcaaggctagaggccaggagccggtgccacgtcagggaggaagctgggtggggccaggcaggagcaaggggaggtgggcggggctgggtggggccttgccacctcggggcagtcttttctcctccctcaccccagcagagcccaggccatcaggccactcgcctccacacagcctagtgaccacggcctgccagtggggagcatctcccgggcagaagggcactgtatgtgtgtgtgtgtgtgtgtgtgtgtgtgtgtgtgtgtgtgtgtgtgtgtgtgtatgtcaggtgtcaagactgaacagcagaaggaaaaaaataacagaatagagtcagaggttagggaagctatagggggtatagggcatggttgaagcagtcttttctcctccctcaccccagcagagcccaggccatcaggccactcgcctccacacagcttagtgaccacggcctgccagtggggagcatctcccgggcagaagggcactgtgtgtgtgtgtgtgtgtgtgtgtgtgtgtatgtcaggtgtcaagactgaacagcagaaggaaaaaaataacagaatagagtcagaggttagggaagctatagggggtatagggcatggttgaagggctttctgagacaaaagactggccatgtgttctgtgatgagctgctatgtggatgtaggaaatgggccaaggtctggcaggggaatcctctttccaggggctccctggctaggtgtttcatagatgttaactgcatgaatgggtgacacccccccacccaccaaccatgctccagctaaggccctcccctcaacggctgctccccctggaggtccgagtatccatgtgacccccatcgacccactcatgctccctactgcccaatctccacccagacccggccacgcagcagcagcagagaagggaggccttcctcttcaggctggtaggccagggaagcctggcccgtggaagccagagaggggtctgtatttgcaactctcccctcctcttcctccaaacatcctctccccctactcccaacccccacatctctgaagccctggtgttttcaggcatagataagcaaccaagagatttcagtcccacagagatttaactctggctgtaggatatttcttgtgcacctccaatgaaattacaaagtaaataagaccaacacagtccctgccttcacagggctttacaatttggcaggaaagacccatttcatagacaatgacacaattacagcagttaggtgacagttggtgacatggtgagtgccaggaaataaaatgcaaggagctaaatgtgtcagcacaagggcaggggaagggggtgtgtgtggcttctccaaggaagaaacataatcagagacctgagggagaaagagaagttggctagattaaggggtacaggagggacaggcattctaggcaaaggagcagcttgggggagtcccagaggcagtgaggagcctgacacttctgggtacctggaagagggccagtgtggcccaagggcagaggaggagagaggggcactgcagggggtggcctgcctgcccttcagacgccaggctctgagggaaggagtgcggcagtgggatcctaggagtggggaaagtgtctcagcccctcatgatcttcaacctttgacgtcaaccccctctcttgtctttacagagctgctggctgcaaagaagacccacacctgtgagtagggggtccggggcaagaaaatggctggggcataatgagatggagaataattcagcaagtgatctgtggggggactgaggttggacagaggtggaggagtcaggaagagatggcaggcaacaggaaagcaaggggaggtgcgaggaaaccacagatcagggcagtgggaggagatgaggaagaagcctgaagcatgaaaggaaacactgtaaagaaactaggagagaacaaaggaaaagggaaccgccttgtgaaaaaaggcgaggagaaatgctggacagaggcagggagatgggagggggtggggccgactgccaggccggggaaggaaggagatagaggtaggggggtgtgcggaggcggggtggcctcaggaactcaggaactcagcgctgctgccaagggagacagggagcctgcaccaggcttttttttttttttgagacagagtctcacactgtcgcctgggctggagtacgatggcacaatctcggctcactgcaacctccacctcccaggttcaagcgattctcctgcctcagcctctcgagtagctgggactacaggcacccaccaccacgcctggctaatttttgtatttttagtagagacggggtttcaccatgttggtcaggctggtctcagactcttgaccttgtgatccacccctctcggcctcccaaagtgctgagattacaggcatgggccactgtgcccagcctgcaccaagctctgtggtcctgagccaggtttggtgttcatctctgtggttaacacatcctgaggtgtgaacaagcctggagccagcctgtgcaggactagagagcaggagagctttatctctgtaggaaacagaatggacaggggcactctgtgtcctggggccctgaaagccagactacagcaggtaagaagggcactagagctcagagaggacttcccagtggacgctagtgaataagaatcctctctagggaccactcagcacatcagctctcctctcctagtttgtggcaaaggctagtcccccagagaatgcacacagtcccaaagctatgcccatcagggccatgcgtgcccttctgtgagcatgggtccctgaatcgagaggatccctccagggtaggagtggccacaccatttctccatagccgtcccttgactgccttgccagttcctcctgagagctcactgccatctcgcccaatgccaaaattgtctagagcctccctgttccaagtagagacatctcagagagcaaagcattgcccttctccatgagctgggcagcccagggctgagggccatccaggatgctacctcctcctgggtgggggttgctttgctcagcataatcctgatcagtgtctcgcctgcccctagccacagggccccacggaaatgctgagcagggccccgggaggaaagcgggtcagggagtgacgcgggtgagctgggggaggggggtcacggaccttatgtgggtggggggagtagggggactttcggagcagcaggaactgggagaggtcaaaccctattcctacccttaacccctgacctcagaaacctcagccaggactatacctccttatccctttcccatcccaccagtcctcgtgtccccaccccaagagtgttgtcctgaggatccaggctgacagcctctcccccactccacggcccagctcctgaagccccaggaaggcccaggaaggcaaggaaaggcctgtgcctggatgagagggtctggagtcccagcaagatcagacacctctcaggagtttgccccacagaatccaggagacattaaggcctcccccaggccgagagactctgaaaattggctcctgaattgagacaaccccaagatgggggtccaagatggggaacccgggggaactccccagaccaagagggagcctgaatactgaggggccctgaagagggactctcaaagccaatgtaccccacaaagcacctaagaggctgagaaggtctctggaattgtttggcccctgagaaggacccccctcccccaggccaaaaaacactccagagagactcacataccgagggacctcccaggctgagacaccctcaaaagcagacttgaaccagagaaaccctcccatccttcaagtgggatccgaagccagtctgcctgggcttgaatcctgactctgccacttactagctgtgtaaccttgggcaagttacttaacctctctgtgtctcactttcctcctcgaaatgaggataatggtagctacttcataaagtttttttattttttctttttgagacagagtcttactcagttgctcaggctgtagtgcagtggcattatctcagctcactgcaaactccgcctcccgggttcaagcgattctcctgcctcagccccctgagtagctgggactacaggtgctcgccaccatgcctggctaatttttgtatttttagtagagatggggtttcaccatgttggccaggccggtctcgaactcctaacctcaggtgatccacccaccttgggctcccaaagtgctgggattacaggcgtgagccactgcccccggcccacataaagtattttgtgaggattagattatccacataaaacatcgagaaccatttctgacacataatagtaagcactattattatgattatgagtatgatgatggtgatgatgatcattatctacactccaatttcagcagtttggctcctaaggaaatttctggtttccttctgtggattgtgggtatttgcctggtgattattactgcttctatcatttccatgtattccctagcgcaagatatatgtggtgtctgcagggaggagcgtgggcatgggagtggtgggacagccccccaggctgcaccacactgggtatggctgttggcagtccacagggtgtcaggtggcacatgccaccaccccaggcagacatcctgtgacttacctctgaaaacatccctgtccctgaagtcacctggcaaagagggtcaggcttggaaggtcctcgggggtaggaggagtagaaatttggcttcaggctcgtgtgagctccattctggctccccagccagaactaccctggcgggtggaaacagcttttaccgcgtgtggctgtcgcatgtggttttggaattttccaacgccccctacgattggctgcccctcccctcacaccctgccccaggcccagattggccacgtggggcgcctgtcatcctactcactgcaccccttgggggtggggtggggggttgtcacttggccacctgtgtggtgcagagcttaaaccccccagtccagaagcactgggggagagagctaggtgcagagcttcaggctgaggcgctgctgagagggcctcgccccgcctctgccgccagctgcaccccactcctggaccacccccctgctgagaaggacagggagccaaggccggcagagccaaggctcagtcatgagaagtaagtgaatggggccacctgggggcgggggagcctggaccctgtcgtcacccctctggaaaggaggatgtcttgggaacagtgtgagcaaatctgagcaaagcagggtgcgtcctggtcaaggtcaagatctgttgggagatgggtggagcagctggggagtcctgctggccaggcggctccctgacagcagcaatggtaagaggactgttgaggaattcctgagttccaaaaagaacctccaaaagtatctgaggtatccaggcccttaattttacaaaaagactgagagccaaggaggccgcgtacttggcccaatgttacacagctggtatctgatgggggctggtaattactaggggccctgaacgcactctcctgttacagtgtttcccttgttacagtgtttccctctgtgcctccagcctgcttgtgagtaaaaggaggccagagcagttgctgtgctctgaagcaacaggacagcgagagtcaactgaggttggcaggcagcagggcacagaatccccgcgtccaggcctcaaagccaccaggctttctgcccaatccagggacatgaggactatgtggaatccagtcagggtgcacccgggcacatgcctgcgtgtgtgtgcatgtgtgtgtgtgcgtgtgtgtgtggggtgtgtgtgtatgtgtgtgtgtggttctccagggtcagtcacccatttgaccggggaagcaaggcaatggagatgggattggaaagacctcggcctcacccttttcctggcttggagccctgggccaacagttggtgggcagatgtctggggttcctgtgccttccagcagagcaagggtgggcaacctcaggaagtcccctgtatttgttgtgaagggaagccagggaagccagagaagctctcagagcacaaggtgaaggaggaaaagggaagccccatgcccctgtggctgaggcctgaagcagccccagcttcaacctggggtcttcccacaagccacagaagggaggccgtattgagtcctggaaagacccctggactgacagtgtaagaccaggcacttgtgccgcctatcactggctagccatatagacttagacaagccaagtcactgggccctggtctaccatccgcaaaacaagggagctgaattttaagatagaacaacaaaaccaactatggagagtctcccattccaaaggcccagggccaagagagagcccagtgccctaaggcaggcatccccaagggtgatgatggagactcagctctcccagaggttagaaggaagggaaaccaaggaaagaaaagaattccacttctgtgacagggactgaggccacagtgcaggcatatgagctggggtggataaggagggctggagagaagagccaacagcttctacacagaggaaagggccccttggagcttccgtttcccttctagcttctctctattagcagcaaacgctggcagactggtcttcccagagatggcccctaatgagcaaatcaaccctgggatgaaatgactaggtgtgcttctagcccagcagcggggcaggagtccccaggaggggctgagggagacacttggccagctctccattattcccacccccaccacacacacacagccccacccaggcggggaagtaggagagagggcctcctccaacgagggggtcagtgccactggtccttctcacttggacatttacaggtatctcatagccccaagttatctgaccccaatgagtgccaaccaccaccagcccctccaaccgccgatggcaaaagtcaaagcacatggggcttgggactgtgacacacccagagaccaagggcccgacaaaaggagcagaaacaaatcaagaaataaggagagatgcagaggcccaactcagagggcgagtttctggaacacctagggagagagtaatgtccagctggaggtgtggttggagaaacaccaatagagccaaacgcatggaggtgcagccgggcgtggtggctcatgcctataatcccacttcaggaggctgaggcttgaggccaggagtttgagaccagcctgggcaacaaagtgagccgctgtccctacaaaaaaagttttttttaattcgctgggcatggtggcgtgtacctgtagtcccagctactcaggagactgaggcaggaggatcgtttgagcccaggagttcaaggctgcagtgagctatgatcaatgtcacagcaccctagcttaggtgacagagcgagaccctgtctcttaaacaaacaaacaaacatgaaggtgtgaagcccagaaacagagctggaatgcagaagatcacaaggcacatagacacagggagaggcggagagaaaagataactggcagtaaagggaagacagggagacacagggtctaggcaagcggtaagagggaagtagggtggctctgacaaggatggcaccagcaccctgccatccgacctgctgctgtcaagtggagataatgtgtctgtacgccaaagagactcccagccagccagacagagggtagcccagacatcttcccctaagggcatggccagcgtggcgccaataggcactcaggccctggcatttggtctggatggggaggtgggaggccgaggggtgtgaggtcactgtctatgagctgatctttcttaggtttggtcatgatcatgaggaacagtgggccagaaaggactccaagtccccagggtacacagatatcaccctgagagcccagggccatcttaggactccgtgaagggcttcttccttcctttcatcactccagcacccttctctttccccgtcttcccattcctaacagaaataccaaaccaccgagcccaaggtgctagactctgaaaagactcagcttgtcccagcagaatgaaaatattcggtccctaccaagggctcctccccatcccctgccgctgtgctgctgactcaaactaacagggaacaggactttccaagggctaaggtctctcccaggcgggcagcccaaggcccgcgctcctgttcccatatagctagtcctttctgaagtctcacctccacgcctgctgctgcagtgcagccccttccctggggctctgaggctcaaaaaggatggagatgtctatttcgggggagggacagtaacaaggcagggcctcagggccagagccaaggtctttctgggtccactaccctcctggagcagtgaaggtgctctgggatgagggacagatggccctgaaggcagggaaggtgctgatggtgacgtctgggctcccactcgccagagcttcctcctagtgattcatcccctcccccattcactggttgttttcactcgcctttctccagtcccagactgtgggggtggcggaggcaccaggagggggtttcgggtggctggctggctgtcattcatggcttttcaaaaccccagactctccctcgcccacctgagttttagcttcactattttctcagccccaggatctgggtgtttcagcagaaaattctcaccaggagctgcggtgagggccctggcctgggctgggggtagtgttcgccaggtagaaccacttctcccccagtccccacccagccctcccgctcctgctcccctgtggtggcacccaccaccttggtttccagctttgcagaagctgggggaactgagagctgagaaaggagggaggctggtgacaggttggggtgtgcaagtgacccctgaccggagctgtggtctcggtggggatcgagacagagagttctggctgtggggagaggaggagctcaagctaaggaaagagatgcattcctctttctcactcattcattcattctgcaaagggaggcataccaagatgtatggaaacctagtctataccctaaaggggctgtggtgttcctgaggagtccccgggaaccctgttgttgatatataagtcatcccacttggccttagagaaagggttaagggcaggaggaggctgggacctcagaggaagagttgggacagagggaataatatctcttgggatctttatacaaacaggagtcctggctttagttctgtgggtttcctctgtgaattctgttcctagaccaccacaatcacctcacacttttacccctacagccaaataaccatgtcctctacccaggtctccggtgtgcatttgggcgtcttatcctcataaagtatatagcttaaggcttgagggcactggctgcagaattacagagatctaggttcaaatgccagatctgccacttctggctgtgtgaccttagtcaagctgtttattctctctaggcctcagttttctcatctgtaagatgaggatgatactagcagggcctatttcacagggtggttgtgatcattgaatgaaaatgcatgtaaagcctggcacagagtaagaattcagccaatgcttatgtctatcattatcctttctccttaatcagtatccactggagaaaaaggagagagaaagaggagaggaaaaggcccagctctagattgacgaggcaccaggaggagatgaggaccccggggtttctctgtgtgaacccattctctaccatgatggtgggggggtggtggttctggggtttgagaggagagatccccctgggttgcagcccctcccctgctcctaccacttcctctctgtggcatagggcacctggacagggcccagggttggcttcctaagctggcacagggccaggctctggaagtactcaaagcactatcattgaatctcacagctgtgagaggctcgattagaggaggatggaggactttgcctctaccgtatttcccctcataggaggagctactaggatgctcctgggggtacttcagtctctaaagcaattcagaggagattcagtttctttttctagtattgtctcagaatgaagtcttagaggtcacactggatggcagaaaagatgcaagaatgagctcaggaaaagatcgccaaccccagccccactccctggaaggagcagcctggcaaaaaggcaggaatagggactaagttcttgctactcaaagtataagctgaagaccagtaagcttaggcaccaactaagagctgaccaaagtgcagaatcttgagtcccacctcagatccccaggtaatcttgtttgagatgcagaaagccatagtcattcagtcattagatgacttaaggagctggcgggtgcatttgggcatttgtctctccttttggaagatgtggaattggagttttcttttggagaaagctctctctcaggagagagctacagtgagagagctgcaggtgagatgcaaagatctttccaagacagcaggcgagggtagagttagggctgccatgggagcagtggtgcaggggctggttcgaggttcctgacctttgcttggctctagttcctggcactggcaggcccttagatggtaagttcctggcaggcctggctccagggcaacagtttgagtaatcctgtgattactcagctccttctccccaatctgagttcccaccacctgctgcttcagggacgtgtctcccaggggtagcttttgaaggtgagttatcatcagaggtgttttcagctcctctcaccaacccccaagtctaccagcccccttcccgttctcccccaccccttctctacaagtaacacacaccctcatgtacacagcactggtactttctttctgaggtttgggtggatggcattgaagggagtgcaggtggcaggggaaggaggggggagcaggactagagggcctgaagtgctgagggggccatgggttgggcaaaggccaggatacaagcgtggattttctgtgtttcagtgtttccgcagccgtctctccatccctagatctatgtctctgtttttcctggacccaaacctcttggtctctccagctcagtgaggctagggggtctgacattctagctcagagtctttggccttgtgtgtctgtctcactgggtacttctgtcttggactgggaggatggaggatgggctgaccaggtggctggagtccaaggctttggtgttgcccaaacatgggtatttgcgaagggggtccttgactggccgcatcttcctatgagaaggtcaaggtcttggtgacactgttgtgaggttcctagggccaggagaagcagtgggtcaagcatggggcagggagatgtgtctggggtcaccatgtggtcagcacacacacgcacgcggatgtggctcttggagaagggaagaggcagggaggcctgtggttgactgctgggccagagcccgagttcccactgcggcttggcctaatctccctcccgcttacttttttgggtggcccacgttggtttctcccatctctggtcttaggccactgaaaagagagatgccacagtgttggagggggaggtgttgggcaagaacagagtccacagggcccgagtgctcctctcagccttgccaggcccactggtcttctcagcctgacctctgctcaggagtaacttgaatacacagtgctttccatgggtgatatcatttcattactctctgttacctacaatcaccccatggacaggcaataatacttttatcctgatcttgctgacaagaaaacgtaggtctagagggagaatctaagtgactagaagtatgggggccccaacgttttctgcccctgttccagacacccagtgccctcttattctctcttcccctccatgtattaaaatctgctcttaatttactggaaagaacctggaaaactcacttaccgcctggtcctggggggaccacagcttacagtgtgagcactggaagcttgctgctgggcaggcacgtgtggctgggggttgggtgaggaattgagtgctaatgaagggatttcagatacccatgtgccctgtccccgtcagggtcagctactgcctctgactcacctcaagtctggcctgagggatgatggtttaagaatgatggaaataatattttggggaatggcgggcaagccatggtctccctgcccacttcacatcaacaggccctacatgtgaccagtgtccaggccagggactggaggtgagatcacagcaatgtgcattcgccctccagagaggctgccacttcttttgcccctttggtgggagacacgtcatagattaaaaggggctttggcccttctcttcacttttctggcctgtcccgccccagggctccccactcagaggggaggcagcaggtcagtgatggtggaaaagagacccatgtgctctgggaaatgctaaaaacacctacagtaaccagggatcccaagctttgcccagctacctttcaaggaagagctgggagaaggcctcctgtggtcccatgaagctcagcagagagtcgtgggcattgacaggaacagggcaaagcagagatgagcctagggccagcagcaaaccacaggggtagggaagcaggtacaggttacagtgagttcagtgggagagagaacctggggtcctagtgccccatgagcagacactaacatacaaatatgcacgtgtggacgcaggagcaaccagatatgtcgtaggctcacaaatgacacatacttttcttgcatatgcacacccacaagcacaccttcaaacatgcccactgaaatgtgtacccgaaaagacaggtacacagaacagcataatggaaagctcaggggaactgggatgtagatccagctctcaggcaaactagcctatgaccctggcccaaccgctttgcctcatctggcttagtccttcatcggtaaatgaagaggttgaatgagatggtctctagtctcagccatttttaacattgatgattcatgttcacacaaatggatacagatgcctttgtacaaacataagtgttcacactcagacacacggatgtacacaaagccaccctctctctgctctggggccaagagcctaagagccctggctaattctttccctaggctctcaggcatccagcagagctggggtgttgaggccccgtttcctgggttcctccctgccatcccctcaccctgtctctgtatagcacctccctgagccttcactgtctggctgggaaggactggcatctctgcctatcccccaccccttgtgtaccacatcttcctgctataccctacactttgcccatgggagctgagccccagcgagggagggaggcacagaggaagccccttcggcgggaagcaggtgttgtgaggccgtgaggagtcctatgtcccaaggcgggagggaggcaactggagcttttcaactcgaagggctgagcaggtggcccctctgcagctgctttctctgcctccatagcactgatacaactcccggccacccctccacactcccctcctctgtgaaacaaacacagcttcctcacaccctttgctgagaagcatttggcatttcacttccccttccattttgcaagagggaaacagcaagctggagctggttggagaagtagtggaagcaccaggtacctgtatctgcagcccaggtacatggtggttgaatgcagaaaagcctcctgggctgacctacttctctttctctcttccagcacaaattgaagtgatcccttgcaaaatctgtggggacaagtcgtctgggatccactacggggttatcacctgtgaggggtgcaaggtgagtcataggcatgtgtatgcctgcatgtgtgcgtgtgcatacacaagcgcgcgcgcacacacacacacacacacacacacacacacagtgtctccttagagataaacaagggggttaatggcctttgttctgactccagggatgatctcctgggcagccaggaaaatgcctgagtagcgccttcctgcagggccctcaacactggcagggccctgtcttaagctggggaaatgactacaggataaattgcaattacacaaatagatggaggagagagaaaactgacaggtcgtgggatgtagaaaagctgccagagcttgtgggctggaggcctttgtgagtgagctgggcctgaccaggataagcagtcttgccctccacctgctttccccagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatggtgaggccaagtcgacagccccctggggttttcctggtgtctccagaggggcagcctggcctgctgagctagacaaggcttaacctgcaagacggcccatcctctggtctcctctccattcctccccgttacaaccccttgtctcctcccctccagggatggatgggtcacccccatcaaagttctttggagtccccaactttaggctttgctagaacaaacatcctctttccaaggtcccatacctcttcatctcttcttacttggaacgaattctcctcactctgctgccctctggcccagctcccatgcagctctggcaccttcccctgctaccctgttgttgtagttctagctctatctccttttctaatcccccattcccatacttggacacaggactatagccaggaatggaaacagaattggcctgagaacaaccagagggtggtcgtgggggagggctggtgttcctggtgccttatccaccctcctcacccaccacctcctcaccagtctccctgcacacctccaccaccacagaaggagcctagggtggagctgggggggcatgaggtgatgaggagccagaaggagcccgtcagcacttttcagtgcccaaaataacaaagcaaaaggaagcacgcaggggtgcaaaggggcaggcggggcgtaggctgtgcccctacacctgggaggggtggcggggggagtaaaaaggcaggaaagagagagcagaagaggatgttcagaaacaagccgcggagcccgggttgggctgtggtgagtatctaggtcaccagggagcctgcaggcctgaccacagggagacctgtgttctcagctctcctcttcctccgaccctcccaaagaggcgaggtgaccccaatacagcttgaggccctctgctcgaccacccccagccccaagatctggaggccagaatccccagcctagactcattgcttgaattctgccatgattcaaatctgatttagaacttagaagattttgcttagcagattgaaatggcagactggacagaccccagaagcaaacaagagtgagaggtggacggggtcttgagcataagttccctaaaggctagagaagctgtgcttggagtcagccattcagagagcagcaagttaatcctttaatgaccaaatgcctcctgaccctgccctgtgccatgttctcctgcctcataaacccctggtccctggacctctttcagctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagataggtgagcagctggggaggtggagagggtggtagagatgagggaggggtttccaccagtaccccgtatcaatcaaacatgcgcctgagggaattgaggggtccagacgaggggcggagggaggaggcggagcaggataggccaggctgagaagtgcccttgcatgggtaggcgtaggagctggctgagatcaagccatgccttccttctccggccccagagcacctggtgcagagcgtctgcaagtcctacagggagacatgccagctgcggctggaggacctgctgcggcagcgctccaacatcttctcccgggaggaagtgactggctaccagaggaaggtgaggccaggagacctgcaggaagggaacgtatcccacccccaccgggagagttcagagatggctacctgcgcacgactgggtcctggggcagggcgggacatcacagacacaggctggccaacaagcatgtgcacaccttttatgtacagttgcgaatgtgtgtatctgtctacaccccagcagatggatgagcgcttttccttagttcttgcctattaaaattgtacctggccttcatcctacctcctctaccatgcagaccttggtgcaccctccttcctcctcttccatcaacaataacaataatcagaaccctgattaccatttgttaaacaccccttctctgccaggcattgtgctaaacgctttatgtaaattatcctcagcccctaccacaaccaacctatgagggtggcatttattcctacttttaacagacagaaactgagcctagaggggttaataggtttcctcaaagtcacaaagtggtggaaccaaagtcaaattcagattcatcaggctccaaagtttatgctgccttttcgatcacactctcataccacctgctctaaacacactcgtttggcacttcacatttgcttctccaggttattgagaccttgggcataacctttgtgggggaaggggcagctgtatgtcctgttcacctcaacgagatataccttgttggagggcaaagctgtatctcatactttttggattccctcacaacagctaactcggtgtcagcagccggtaggtgctcagtgtgtgggactcactggcaggaatctgtgcatttgtgctaagaccaggcttttgaaaatgctagttgagaacataggagttcagagcctaccccttgcagtttattaggtggggctccagggctcaggaggatcacagggccacacagagcgctacagcgggaccctcctccctccctgcagtccatgtgggagatgtgggaacggtgtgcccaccacctcaccgaggccattcagtacgtggtggagttcgccaagaggctctcaggctttatggagctctgccagaatgaccagattgtgcttctcaaagcaggtgcccagggatgggtgggcaggcctggggacaaggggacagagccaagtggagggaggtggcttaaggaaatcagggggacagagtcagatcctggctttgcttgacactgtccctgcatcttctctccccactgcccaggagcaatggaagtggtgctggttaggatgtgccgggcctacaatgctgacaaccgcacggtcttttttgaaggcaaatacggtggcatggagctgttccgagccttgggtgaggggcagggagaaatgagagggaagattctgatgccaaccccaggcaaagctttgtgacccagggcaccctcttttcagggcgaattgccccctctgctctaaacacaataagggcggtgtcctcgggcaccatcgctccagccactctctcacttttctcatttccactccatcaggctgcagcgagctcatcagctccatctttgacttctcccactccctaagtgccttgcacttttccgaggatgagattgccctctacacagcccttgttctcatcaatgcccgtgagtgttgctgggcttgggtgaaggacattcaggtggcaggggcatggcagatattgaagaagagtctagaccttcagatgtagttaaatctgggaaattgctttaaatagcagaatgagccctactcagtattgctataaaataaaatgagttaaaataaagattcagaggactctcagagagggacaagagcagcataaggtggggttgtgggaagtggggagaaatgaggttgagaggaaatgagccactttcctgacagaaatgtgtctgattgttagtctatggcagtgatttcattgtagcacacatcagaatcacctggggagctttaaaaactattgctgcctgggtcccacttccagagattccagtgtacatgtgctccatgacttatgatggggttatgtcccaataaacctatcgtaagttgaaaatatggtaagttgaaattgcatttaacacgcctaacttactgaacaccatagcttagcctagcctaccttaaatgtgctcagaatgcttacattagcctacagtctggcaaaagcatataacacaaagcctattttataataaagtgttgaatagctcatgtaatttattgaatatggttctaaaagtgaacagcaggatggttgcatgggtattcaaagtatggtttctactgaatgcaagtggctttctcaccaacataaaatcaaaaaatagtaagtcaactcatcataagactgggaccatctgtaattgataaggggtgcactgaattttaacagccacccccaggccaccaagattaagaatcactgctctgtgtgaactaattttaaggctgtatgcctataataggaagactctggatatcctatccactcccctggcatggagtagctgggctgagccagatgaatactaaatattcagagaacctagggaagtgggtcaagctgctaacctgagtttgcagatcgagactatcagtcttctggctctgccagtgagtggacacctaaatatgcccttcaaactagaagataaaaactttaaagatgacttctggatattttatagaatcagggcaaaagttagtcacagattgctgcaagccccctggtgcaggcctgggcaccttcaggaaggccacctcctatcaggagcccttttcgtacatgggggagctcttttccaactcttgttacccctatgacagaatcctagtgcctagcattgaatgagctatgtggaatatcaggttaccagggagaaggtagcttggagtcaggagatcagaaattctcatacctttcatctcttcccagttttccttgtagacagctagccaagcccaacgtccagagcttaccattatcaaaccaaggcacacacatgcacgcgctcagcttagaagacctctatccagcacagatgtccacaaagatacacccttttgttgggagttaatgtccatgttctttcttgttctcattacggtcccaccccctcctccagatcggccagggctccaagagaaaaggaaagtagaacagctgcagtacaatctggagctggcctttcatcatcatctctgcaagactcatcgccaaagcatcctggcaaaggtaggagcagtccctggggtagaagaggccaggcccatcgctagctctgtaacatcagagtttgcgagggccggggtctgtgggtacagaggagggagtgcgggagtaccactctctgttagagagcttgcatcagcagtgggaactaagggaatgaacagctacttccacgtgcataaagactggaaagttagagggcctgggattgggagggacctccagggaacaattcagtttaatatagccagcacttacccagcacctgcttgtacaaggcactgtggaaagacacagagatttggtcgctgcccccaccaagagattttaatctggtatgaagaagagatctgtgtatcactaactctaacatagagtagaatgtggtatgtgatataataataatgcaattaacagagtgcttttgctgacatgctttctcatcctcatggcaacccagtcaataggacaggtgttcaaatctccctgtgtagcagccgggcacagtggctcacgcctgtaatcccaacactttgggaggccaaggcgggtggatcacctgaggtcaggagttcgagaccagcctgactaacatggtgaaaccccatctctactaaaaataaaaaaaattagccaggcatggtggcaggcgcctgtagacccagctacttgggaggctgaggcaggataatcgcttgaaaccgggaggcagatgttgcagtgagccaagattgtgccattgcactccagcctgggcaacaagagcaaactctgtctcaaaaaaaaaaaaaaaaaaaatctccttgtagctatcaggagacttcagtgacttaaatgcaagattgaatcccagtgctctttgcgctctttctatccctgtgtcccctatgtataactataataagtgacaccaggaaaatgttatgagagtataaaacagggattaaaaataatttgggggtaaaaggagtgggtcataaatacttcccagggaagatgacatttatactaggccatgaatgatgtaagattttaacaggcattcatgggggtggggcaggcattccaggcttagggaacaataggagcaaaacaaaaaaaatgaaaaaaaatccttttcctgaggtttaaccaaaaaaatggatgagatgagtatgagaggctggggataattgttttatgggatttgggtgtgggactagggtacaatgaagaccaagaacaacaggagaaaaataaggaggcaaaatagtgtgtatgtggagaatcactcatggtacatcctcactaaagtgtaaaatcaggagctgggatagactggtggggcagaagagcaccagatgatcagcctgaaaattaggtcaggggcaaatcagagaggactttcaatgccatataagagttaaagctttatttctaggccacagggagctccaaaggctagaaaaatgacacaatcagagctgtcatttaggcaatttactttggaaccagtataaaggaaccatttatgtaattattcaagcaggcctttgctatgtgccaggcacagggctgggtgttaaggatacagcaatgacttacacggtctgtgctctcaagaacttgaactttaatctgctacaggatggatttgaaggaggagagacaggaatctgggagagcaattggaaagcaaatccggttggatctgctttcaaaatacatcaccttccctactattaccaccaccctggcccctaccagctctcagctttcacttggactttaagagaggcctcctaactgagcccctgttccaccctcatctgccctgtagcaaccacacctactccgcacccacggtagcccttttaaaaatgcaatctcatcatgccctactcctgtggtttttttcttgtttttgttgttgttgtttgtttgttctgtttgtttgttttgaggcagacttgctctgtcgcccaggctggagtgcagtggtgtgatctcggctcactgcaacctccacctcccaggttcaagcgattgtcctgcctcagcctcctgagtagcttggattacagggattacacgcccggctaatttttgtatttttagtagagacagggtttcaccatgttggccaggctggtctcgaactcctgacctcaggtgatctgcccaccttggcctcccaaagtgttgggattacaggcgtgaaccaccacacctggccttgactcctgttctcagccctcctgtagctgcctgtgatgccgagaatcaaatctagagtctgcgtcatggtcaagtggctcataacatgatccctgccttcttttctcacttgatcttccactgccccttcaaacacccattgcagccacacttgcttccttgctattcctcgaacacatcaaacccagtcgcagggcttttgtacctgctattgtagtcacctggagggttcttcccccagttttccaaatggcttaccccatctcttcattcgggagaggtttttcctgaccagtaaccccatacaaaaagctttagttttctttaaagaacttattatctgatacactacatatttattttctgggcccctcaccagaatgtaaatttaatcaaggtacagattatactttattgactgatatatctgatatatcactagaggccatcacagtgcctagctcagatccagatgtgttctcaacaaatatttgttgaatgaatgaaggaagctattgccatagcccaaaaaagctcagaataaagcagtggtgaggaagagagagaatctaggagatatgaagggatcacaccctgctgcctgcttttctctgactgcctctttccaaggaaactaagctgggggagggaggcaatggcaggcaagagacatttttaagcctcttggttgtagaggagactgcaagagataaattgttctttcagccttgctccagtgaggtctccctgcctccgtctgctcactggtttctgtgcctttttcatctcccctttggctgagtgctggcagcattggtttgctacttgcagtgttaggtgcctgcttagaaagtctgtttagttcaaagagttattaagcatgtgccatgtgctaagcattatgataggtacagaggagacagggaaagagagacctcagccaaggagctgaaatctagggtgggaaggcagacaaattggaccattttcctgcaatgtagtaagtgctacacagaggaaagcccaaaagaagggcccttaatccagatgggaggcagttagggaaatagtcttaggagaggtgacactagagggtaaggattagtaatgggaagaggggaacaacatgcacaaaggcagaggcatgtgacagcatacaacaagagtcacagacaatcactcttataaaagcaggaagtgcacattagagtctttgacaaggttcattctagaagtattgggaacataaattgagggcttcacccagaaaacattcacctgtgccccacccactctcacttccctccagtgtcctgaacacacacgtacttctaccagtgggatttggctggtgccaaagtgccaagtacataaggggaaggcaaggagggtttgtcctagcccaggaagaataagcggacttctttgctctgaggagagctgaagtattgaccctcccttccccattaacccatatccagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttacattttctgcctctgccttcctcccagctcagcaaggaagtatttgggcaccctaccctttacctggggtctaaccaaaaatggatgggatgaggatgagaggctggagataattgttttatgggatttgggtgtgggactagggtacaatgaaggccaagagcatctcagacatagagttaaaactcaaacctcttatgtgcactttaaagatagactttaggggctggcacaaatctgatcagagacacatatccatacacaggtgaaacacatacagactcaacagcaatcatgcagttccagagacacatgaacctgacacaatctctcttatccttgaggccacagcttggaggagcctagaggcctcaggggaaagtcccaatcctgagggaccctcccaaacatttccatggtgctccagtccactgatcttgggtctggggtgatccaaataccaccccagctccagctgtcttctaccactagaagacccaagagaagcagaagtcgctcgcactggtcagtcggaaggcaagatcagatcctggaggactttcctggcctgcccgccagccctgctcttgttgtggagaaggaagcagatgtgatcacatcaccccgtcattgggcaccgctgactccagcatggaggacaccagggagcagggcctgggcctgtttccccagctgtgatcttgcccagaacctctcttggcttcataaacagctgtgaaccctcccctgagggattaacagcaatgatgggcagtcgtggagttgggggggttgggggtgggattgtgtcctctaaggggacgggttcatctgagtaaacataaaccccaacttgtgccattctttataaaatgattttaaaggcaagaagtgtgtgtgtcagagggtgggggagattcttaaattagattacctgcatgcctgctctccagtctcattcctgggtcaagactcaggtttccagctcagcaatccatcagcattatacagatccaacccaccctcacccgacccctgcagtttctccccaggtggagcagtccctcagtgaggactgtgaacgaatcttcaggaacccccactgtaggagcctcaaactgagccccacgggagatgctctagactgagaacttcccataaatgatacccacggggaacgtttagatttagaggttgcacagaattgctccacatctgggagaccaaaagacagtcctctggaaggtggctggcccaagctccccagtgggggaatcaggatgtcagagagatcctctagaacctgctgttcttgctattgcatgacccctccctggcaccagagcctccctcctggctccctcccctgtcacttgccagcctgtagtggtgcttgctgcagccctccctggttgctttatttatttattttgcaccaacagggttgctgcagactcattcttgcctggtttaaaaagagagagagagagagaggaaaaaaaaaaaggagaaatgctttctggctcttttctccacctcagtcttggcagcagcggccgcagcagcaacagcagcagcagcagcggcaggcagcagccgggcagccaggcagcgggggttgaggcacacagggaaggtgcaggggcctgaggtgcagctcgaatgggacagggcccccagcgctggacagatgcagtgccaaacttgatgccaccttccagcttctccggtaagtgcccccactctctgtcccaaagatgcagccgcccttttccataacattctccgagacaggccagactaggggccagacaggcccctcaaggcaagagggtttgggcccccacactgctaacaattaatcctggccccatgggactttgagggggaaactcaaatatcccaagtacccctgggtggaagggctccaaggagacctcccttccatctccccagtgcttccccttcctctggaagggtttttctccacaatcggtgtggatcttccagaaatctttcccccaggaaccctctccccacacagttcccatttgtcagtcaggtgtgctttaaagaggatacaggatacccaggttcaaaagtgtctctggactgccacataaagacaagaaaaaggctccctacccttgaggggtgatgccttcaagggtcatgtcttggtgatgtccccaccccactgaagggacaaaaaagtggttctgacatctcgcttcctgcaaagtggccggaagccggtcctgcagccatggaggttggcaagggaaatttgtgattaaattagccaccttagaaataaaataggttgctccagctccctcagcccctggcccagcggactcaggggaaactcacaggagcaggaaggaagaaagctgggttacatgcttcactgcacttttgctgaatgcagagcgaggatgggcaggaactgcagcagtagtgatgaagagctagctgtcaggtggacttcccagaacaagcctagggagaacaagggaggctgggccatctttcccgggagagctctgggcatgccacagagacctgttaggtcagtttggggcgagaagagtctgctctgcagtctttgccccacgttattctttttcatccccaagcctcacaccagttttctgcatccctctgctcttttggcctctttctttagtttcccaactaggacaatcctctcaagtggctgtaggatagccactagaatgatccttctaggaggtggagagtgggaaggaaaggggaagaaatgaccatctcttaaactgcctctcctaagttccacatgagaaaaaacagggcatgtagtagaaagctgaccctgtagagcccagagagcctgaagcccacaagcccaaaggtgatcaggattgccgctcagcagagactcagacgcgctgtatcccagagagcatccatgggcttttgctcctatctctgtagccatcccttgccaattccagtacttcctctgccttggggtccctgttgacatctaacaggatgagtcaggggccctcatcacctagagggccccttctcctctgtcacctcagccattgtagtcaccatcttcctgagggttcccggaacctggtacccagaaactgactataagtctacaggctctgcacactgtctgtgcccagatacctgctgtgccagccaacagctcccttcctccccaccctacagcacttggtcagatgctgtctctcctcacttatctatgctccctggtccacaatctgtctcttgggaatttctcaggcagctcaggccaaaagggacaagagctctccctcagatccacacactggaccagaatccaaacaccattaaggagggatatgagggaagcccaagactgaagaccaagcaacagaactcaaaacctgggcatcctttgggtctctcacacaccccaacttcaattgcagtagagaagcagttgcccctgggctcttgcaggggattcccagcttcccagtcaagtgcctcctgcatcctatgccacagctaatgtacagcttggcagttgtccacacaggcattttggggagattggatcttgttagtccagggctcaggccctgggccaggctggaagagggctcagcatgggggtggagctgaggcctgcatgtttcccagccttgggtgagctagtcaaggtgaggacctctccagtcaggacagggaactctgggccaaggacatgatctccctgagccttaagcaaaactatgggtacataatgtgaaagaataagcgtgagcagagagggacagagcagagcttgggaagagcaggtatcagggagaagggacctgagatcctcctggatctcacagacatcaggaaaccccatacagaaagactcagtacctccctgctgttccctgccccattcccataagctttttccccacagaaatcaggcttggctagggttccatgagccagtaagcacttggctggttatccagggctggaagagggaggaaagcagagattccccaaagagaagctccaggaagccccagggaggtggcacacaagaattcttcctggttctgtgccctacttattggcaatgctgagacagatagaccaatttctctcctctctaagaagggccaggaagtccagggtcaccgtcatctgaagccactttccaaaaagggccatgtcatcatctattccaggactgaagagggaatggatgcagccacagctccaaagcaagcctggcccccatggcccccgctccttttcctcctcctcctacctggagggagcggtggcagctgccctgctgtgtgtgactgcacctcccagccccaggctgtgctctgtggccacaggcaactggaggctgtacctggaggactcccactggacactgagctcctggacctgagtgggaaccgcctgtgggggctccagcagggaatgctctcccgcctgagcctgctccaggaattggacctcagctacaaccagctctcaacccttgagcctggggccttccatggcctacaaagcctactcaccctgaggctgcagggcaatcggctcagaatcatggggcctggggtcttctcaggcctctctgctctgaccctgctggacctccgcctcaaccagattgttctcttcctagatggagcttttggggagctaggcagcctccagaagctggaggttggggacaaccacctggtatttgtggctccgggggcctttgcagggctagccaagttgagcaccctcaccctggagcgctgcaacctcagcacagtgcctggcctagcccttgcccgtctcccggcactagtggccctaaggcttagagaactggatattgggaggctgccagctggggccctgcgggggctggggcagctcaaggagctggagatccacctctggccatctctggaggctctggaccctgggagcctggttgggctcaatctcagcagcctggccatcactcgctgcaatctgagctcggtgcccttccaagcactgtaccacctcagcttcctcagggtcctggatctgtcccagaatcccatctcagccatcccagcccgaaggctcagccccctggtgcggctccaggagctacgcctgtcaggggcatgcctcacctccattgctgcccatgccttccatggcttgactgccttccacctcctggatgtggcagataacgcccttcagacactagaggaaacagctttcccttctccagacaaactggtcaccttgaggctgtctggcaaccccctaacctgtgactgccgcctcctctggctgctccggctccgccgccacctggactttggcatgtccccccctgcctgtgctggcccccatcatgtccaggggaagagcctgaaggagttttcagacatcctgcctccagggcacttcacctgcaaaccagccctgatccgaaagtcggggcctcgatgggtcattgcagaggagggcgggcatgcggttttctcctgctctggagatggagacccagcccccactgtctcctggatgaggcctcatggggcttggctgggcagggctgggagagtaagggtcctagaggatgggacactggagatccgctcagtgcagctacgggacagaggggcctatgtctgtgtggttagcaatgtcgctgggaatgactccctgaggacctggctggaagtcatccaggtggaaccaccaaacggcacactttctgaccccaacatcaccgtgccagggatcccagggcctttttttctggatagcagaggtgtggccatggtgctggcagtcggcttcctccccttcctcacctcagtgaccctctgctttggcctgattgccctttggagcaagggcaaaggtcgggtcaaacatcacatgacctttgactttgtggcacctcggccctctggggataaaaactctgggggtaaccgggtcactgccaagctcttctgacctttccttccccagtggggaacccaccaagtccgcttcagataccaaaggggaagacagaaccaaggctgcttgaaccagaacctagtcccgagcagcaccgctctcctgcacctcccgcctgcgttgtgcctcctgccggagagtctgcttcctgagcttttccggtctgaggatagcattgtcatttcttctctgagggtcccagggagctgcagatgcagaccccgtcgttagtccagcccccgcttcaccccctccacacacaaaacaggaaacataatcaaagcgctagtcagctagtctaaccactaggctttcttcacacatgcttatatcctttaataaccaattgccaaccacggctataagattatttcagaggtggggctgggaagtgccacttgctccttagagtctgtttgtcaaccaggcagagtccctttcttttctgctccccaccccaaccctgcccctatgtacaggaataagagcaaaggacccacaggctacagagaagaggatggggacagagtgtgggatggagaggacagaccatatactgcactgtgtttgcatgagcctctaccaccttcctctatctaccagatcattaaacctgctgtcaaagggccacaacagtagcagccaaaactaaatgtcatctctggagttttctttacttcagtctatttcctaccctcatttctgttatatctccccagctccttctctttctgcttgcccattgattatgtgtcccaatggcattgcctccatctaacctgcctgacaaacagggtaaggagtgcccctcccaccttcactttcctcaccgccctgcacccccacctccatgcccggagggatcagcactcctagccccggtttcagcctcaatcctttccctttcactccccatccctggaactggagaaggagcgatcctctaccttccaggggacccctacatagaaattccacctgggacacccagttgctgcctctctttcccatttctccatgggagctcctcatcatttttgcgtcacagatccctagtgcccttggggaaaactcagaactccaagataatgactaacaaacacaagaatccgcagttgtcaaaggagagagacccaggacactgcagagactaggcttggaggaacagggaggagggcacagcaggctgtagtgagaagtggagggaagggggaacagcagtaactgcctgcctagttaatttccaccatccttctgcagcttcctctggttctgtgcttagtgcagccccagtgggaagctgtctccgggtagaggtcactgatttacagagacccccagatggggaggtggagtaggaggtgaaactgctgagtaccactgactgtgcttcaaatagagggcaaagcagagcccaaaaagaagtagagatgctggaagctcaaggaacagagcaacagcctcagcatcactggaagggaggagtgacagggagaggagaggagtcggaggagggactgagaagggaagaatcacgtggccctagggagcctttctgcgcagtagcatctacccagcgtccttagtttcctcccacccacccctacaccaaaccagatgcaagcattgtgagctttctagttgattcctgctgctgttgtccttgctctgaggagactccactcattagaagattcccagctcaaactgcccgacagatgagacgctcagagccactgaggaggtgaagctggacttcacaggcaggccgctctttagtggggcagagataggaatatgggggtagtaccagaggtgaatgtgagaaccaggcagacaggagagtggggctggagaaactgacctgcttgagaaacgagtttccctgagcctgcaacctccccacccaccatgcacacacaactcaatcagcatcccagcaacttccccttctttagtgtataatgtaccagacagatttcctggggcacagccctcccgctcctttccataaccttccaccagcagcttattaggttgggacttgggagtcagacgctgaaggttctcactctagttgccctctctgcaatgcggaagcagcaatgctgttcagagaaatcttctctgggaagcccctgacgctctggggaacagatgactgtctggtgctgggacatgctgctgcccaaggtctctgaagtctcaaagtctccagagcagagctacccaacagacacagaatctaagtcacacatgtaatttcaaattttctagtagctactaaattaaaaaatcaaaatgaaacggatacatttaaatacttactttatttaacccaatatacccaaactattatcatttcaatatattatcaatataaaaatcaatcataaaatatttaacattttttcatattaggtctttaaaatccagtgtatattttacacttacagtacatctcaacatcgcaattcagttactaaattttcaccagaaaaatctatatttcatacaggtcactgttgagaaagtggattcacacatctaagttttttcaaacataaaacattttccaataactgaatcgaatctctgtcttaaattttaaattaaacaaatttaaaattccattcctcagctgtaccacctacctttacaagcattcaatagccacatgtggccaatggctaccatattggacagcaaagcttcagacattgcaacctggcgtatagactaaggtctccttggcagtggtgggtggacaaagtatccctcaagaaacacatttaatctcaaggaaatgcctatggagttagtcccaccacagccccttagtctcctttcacagctttaccagaacacttttgaggggtgaagcccattcaggaaacaagcttactatgatgagcacttccacagcttgtccaagcgttagcatgccagtccctcatcttacctgtcgggaagactgccctcagctcagctgtgatggcacaggctgctgtgtgtgtgctgatgagtgtgcaaatgcagccaaggacatgagtgggtggtgtgtatgcagaagttttgtggcccatgtgcagggatgtatggtaccacatcatggggacaatctaatggaggctctgcccagggtgggacagcagttcaaagagaagaaaataacatttattgagggcctattctatgtcagtggctttatatatattttcttatttaatccttacatcaaccctataaagtagggaggcatcttagctggtgaaactaaaggtcaaagagagtaagtgctcaagtgcacagagctagttagtaaatagtaactagctatttgagctcatggctgtctgattgaaaactccccctttccaccacactgccatcctcactgccatgccctcacggctctctctcccagggcctttcagttgcaggacacgacctgtaagaaaggagaaatcttccaatgcatccactctgaactttcagtggggactgggctaagttattggtccttacattcttcattaactctaatgcacctgattcaggatgttggggtttttctttgtttttactctttcttctcagtcccctctcccaatgtccttacagcctctgcctcagggac

SEQ ID NO: 1557 - DNA, 1819 bp, Homo sapiens
cccctgggccctgctccctgccctcctgggcagccagggcagccaggacggcaccaagggagctgccccatggacagggccccacagagacagcaccgagcctcacgggagctgctggctgcaaagaagacccacacctcacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctggggatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtgggctgtccaagtgacctggaagagggactccttgcctctccctatggcctgctggccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggg

SEQ ID NO: 1558 - DNA, 1683 bp, Homo sapiens
atggacagggccccacagagacagcaccgagcctcacgggagctgctggctgcaaagaagacccacacctcacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctggggatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtgggctgtccaagtgacctggaagagggactccttgcctctccctatggcctgctggccacctccctggaccccgttccaccctcacccttttcctttcccatgaaccctggagggtggtccccaccagctctttggaagtga

SEQ ID NO: 1559 - DNA, 21898 bp, Mus musculus
tgtgggcagaaggccgtccgtctcttaacagacgggcctctcctccagttctagtctggaagctgctctccagggaactgcttctgctgtcactgcaaaggcaacacctacgctgtttccagaactgtgggatttggcaaaactgatctagaagtatgccatctggggctaggtcaagaggctgggggagcaggggcaggagagtgcagggttctggtaggaaacccctgagtgttaacctcagcgggataaaactagtcacaccatagccgccatgtaggttaggtgagatctgcttgatggcttttttttccttcactttttgagactcttaggccctgcccagactggccttgaggtgttcccgagggctgggattacaggagtgtgttgtgaacttcctgtctttctaggcggggaggctgtttctgggctggctatctgccagtaagtaacacaaatgaactagaaagaggctgtctgcactgtggagccactaccgatgctgactggagatgttttgttgacgtctctctaccgtggctccggctagcttggaactcactatgtagagcagactggccttgagtttgcagagcccggactgcctccgcctccagaccgcacccaccagcttaagtaggatttttgttacagaattttggtgagaatgaagaaaactggtctggcgcctggtaagtgtcaagggacatgagtccatccctaacacacagcagcagatctccggcataacaccaagtaaaagtttcaagtcctctggccggcccagctgatcatgtgacaaagcatggatactttgtaaggtgtttgtggcattattacaaggagagaagcaaaactaagggggtgggggtggggtgagtggagctgggatctgacctgagcagtcaactgcaaggtaaaaaaccatcaaagaaacaaagtagtcactgagctgaaagctaggaaatgtaaagaaagagttgcgagctatgcggctgggtgtgggagacacaagcctacaacctcagcacttgggatgcagaggccagcctgagagactcggtaagaccctgactcaaaaacaaaaacaatcgggctggtgagatggctcagtgggtaagagcactgactgcccttctgaaggtcctgagttcaaatcccagcaaccacatggtggctcacaaccatctgtcttgagatctgacgtccacttctggcacgcctgaagtcagctacagtgtacttatttataataataaatatgggcaggagagagtgcggttgccctaaaattcaattccgaacaaccagatgaagactcacaactatccgtaccgctatagtgtgtactcatatacataaaataaataaatcttcaaacaaacaatcacaccacgctagcacacaccccttagttgattgggcgatgttaggataagcttttctgttactagagaggtatggccacatcccaaccagggatcttcaacagttcccaaggaccaaagaactagcttatttcccaactattttgttgtgtgatacagggtctctctgtagtcttggagctcactgtgtaggctacatacttagagagattctcctgcctctgcttgcccagagtcaaaagacctgcgccaccacaccaggcctttatttcccacgcattctttctagttcagacctggccagcttctcaagaccagttcccacggacccactcaccatcagggccctggcgggcagcagcgtgcagcgccgtgtcgccatggcggtcctggtgggcagggtcagcgccgagacgcagcagcaggcacagggcaggggcatcgtggcgggcgcaggccctgtggagaggcgggggctgcccagcgtccacatcaagcccgggatgtcgctggaggagagcctgggctcgcaccagccgtcctgcagacaagtaccgccggaagcgtcgctctcggcggtgccggcgggaagcggaggccatggaacaactctggggctgaggaagaagtgggaaatggcagcggtgaggtcccagctccgctcttccccgtttctccctttacctcccatttcctcccccttgcatctccagcaagagataaggcctattctaaactctcatcccttagcagatggcaagtttggggcgcagggtggggatggggttggagttgggggctggtggggaggggggaatcacagagttaatttttgatgtaatttttgagaaaatgatacatagttgttttaaggttccagagcccaagaaaaaagttaattctgaactttggagggaaacaacaacaacaacaaaaatcaagtaaggccagatgggggcaattttcattagccacaaatctggagaaaagtcacaaattcaaagagcgatctagaaatggaatataatgtacccgacagacagacgtagaggcttcttcctctggggcctggggggaggggttactcatcagacctgctccccgccccccccaaggaccctcagagacggaggccggaggcctgggcttaagacgctcggagaagggaggtggggagggaggaggcgcgccaggatgcaggaaatggcgcaagcacacgcgcaagtttcgggcggaaatgaactgtgtgttccatcccggaaatcgtaccgaacgctcggactgggtgacttgtgattaggtctccggaggggaaacaagacaatttgcgacatagggtcctcctgcaagcggaagatgagaggcgagctttcgaagggaggcagaggcagaggcaggcctggtctatagggcgagctgcagcgacagccaggactacagagagaatccctgtctcgaaacacacacacacaatctcacacacacacacataatcacacacacaccacacaaccacaatgaggccaaatatatgggtagatcaaaaaagaaaaacacatggttagacactaacaaggcaaacgtaggacagagcagggagatgtgtgcagacgttcggatttggggggaaagtctgaagagaagatggaggctgaaaagaggggggaagggcggagggaggcgtggagacacagttgggagtgtaagtgaaacccagcgtactgtgtccaagcgcatccttaccttcccacaccattctcatcgcctttgtgtctccttcgagaccaccaatcaagatctcacacccaaacactctgccctccgcttcccccagacccatctctgtggaccctggtgacacggagaggccctgcacctgctgcagtagtcagcacagggctggtctctgctgccctcgggcggccgtttcgggtactacctcagtgaggttcgagaggaggaccagtcatcagtgtgaggatgacagacaccctcccggtgcaggagactgagtgaaaacgggagcgctaagacccagtgggagtggaggaccgcatcaagggcccggaggagtaggcgctggagggtgggagccgtctggtacctcggtcgccttcggaacagcatcctctctagtgataaaaatggccagtcagacccagggtatccagcagctcctccaggctgagaagcgggcagcggagaaggtggccgatgccaggaagagtgagcccccctttcctctcttaggaatatggaaggagaatttaggaatagaggatagcgggcatttgagtccttaggaaaaaaaagcccaaggacaatgagggcagatgggggactgaggctattagggtagaagaaacgggtgggttttacagtctagcatttggttggttgacaggaaactggataactttctagagggcactgatcccattaacgcacctggttgtgtgtgtgtgtgtacactcactgtccttctgcctctagggaaggcccggcgactgaagcaggcgaaggaggaggctcaaatggaggtggagcaataccgcagggagcgggagcaggagtttcagagcaagcagcaggcggtgagttgagggggacagggatggccccacccaggtgcaaatcggtgggtgcctcttgccaggtgtatacaggtgactaagaaattagggtgtctgagagctgaagaggctctgacaaggaccacacattggtaaagctttgacgggatctgtaaggtctgagggttttaaagggtacatgagacttgtggggcggccttcacagtctgtatggtggggacagttttatggtcagtctcagaagtaaggattgtgcccacctgcttggtatctacatgtttttgtggggtgggaatagtttcgaaaaggcttcccaggccttcctctgaacccttcctcctacatgctgggaccctcctttctctgtgtctgcttttttctttctctcctccgcccccatcccccaggccatgggctctcaggggaacctgtctgctgaagtggagcaggccacaagacggcaggttcagggcatgcagagttcccagcagaggaatcgggagcgcgtcctggctcagcttctcggcatggtctgtgaagtcaggccccaggtccaccccaactatcgggttactgtctagaaccatcgctcagggacacatccctagagtgactccttctgtcagctccgtccacagagaaatatcccaactcaaaaccacttgtgtcgcatgcgcagagccttgggttcaatccataatatcatcccccccacccaccaaatcgcttcacataataacctgttgctggaggggaggcttctatgtgacaggatccaatattcccccctgagacttacaagtagcctgttcaaacccgacaaacccgaatctctctgttccatgacacccactggaagtttactaatgaatgcccacgtcatccccaccggacccctctgtgaaatatatgtcctggtgacagttatgaaagcaccctgacttcagagcaggggaacctctgttcctctcccacccctggtccttgctggttacacaactgggacaactatttaacctggaagcctcagtgtcctcatctttgtgactggaatgacagcaacaacgctcactttgtaaggtggctgctgtgaattatctgtgagaattcagcatagttccagatgacggagtgcctgtatcatgaccgcactctgcgtgcctgccagaattctaaccccctctcctgacttttttattcctcgtgttccagctttgttcagccactgtgacactagtaaccctctaaagaatttgtttctctggctctcccttggcacatcatgcccccgaacagttaaatgataatgttatttagcccctctgtccgagtcccaaatatatatcaaatctcttagcacctctctgtttctcctgagctggtctttctcatggttggcccccctctttctctgttttcccaaatcttgctgcttccgggagctgaagatatctatgacattcacatgcatgcattcctttgtgtgccctcagcaccttgcctccttgtgtaacagcggagtgtcaataaaatactggtggatgagtcaattgtcggtgaaagcagcctcctttttgccttgccgttgctcactttggttcgctgtcctcagagttatgcatttatatagtttccaaaacactgcaaagggctgtcctggaagctttatggagaaacaaaaggacacagtactgtgtcccctcttgaacagagagttgcatagatagttgtaagggaaatgttggcagagcagcactctgtccctttcctggttttacactgctcatcagcaccagagacagagacagacagacaggcaggcaggcagacagacagacagacagacagacacacacacacacacacacgagagagagagagagagagagagagagacagagagacagagagacagagagacagagagacagagacttactatcttactaagtatctctgactaccctggaatttgctaggccaggctagctttgaactcacaagagatccacatgcctctgcctcttgagtactggaattaaagacgtgcaccaccacgcctggcttgacattatgtttgggtattggctctcattatgtatctgatgataaaggtcgttgtatccccagagcctagatagcacttggcacacacttggcagttgaggaatactttggaataaaaagatgctggggtggggaaggaggaagttggggtggtggtggtagggggtgagggggtgggacactactggtctctgacccccattcctttatcagttctcttcactgctcatttcaccctgaacttgaatcaatgaggtaattcatagtcttatatgacttttctgtagagagacattaaaaaaaaatctataagccaggtgtggtggcgcatgcctttaatcccagcacttgggaggcagaggcaggtggatttctgagttcaaggccagcctggtctacagagtgaattccaggacagccagggctacacagagaagccctgtctcaggaaaaaaaaaaaatctatgccaaataaggcagtcatgaaacaccaaagatatctcaccacccaagtctcacttggcagaccaaagagctcgctggagttattggcagtatggtgggtgataggttacttataggagtgagactggagtagcttcccatcagaaagtcgcccaccagcgtgacttgtatgcagaccaaagagtcctgccaccaggagctgtttattggtgacacaatctgggagaagtgttccgtgtcttgcaactttttttctgaatttcctgagccttctccactctcatcaggaggaaatgtttcgggggaaatagctatacaaaagcaaggagatttttgaagaggagggacacatgtgataggaaattggggtgcttacaccctggtgtttccctgctagctgtattgccttggccaccttgttttatttctctattttcatatgtttacaggaagagtggagcggggcatgggtctgcattcaaatcctccagcaggagaattgagagcttgaggccagtctatataactgctcaaactcagtaacagagaaaggaagaaaaaaatggcaagacagatgaggggcactcaccttgctgtggccccagtggcccaggttttaagcattgttaaaatcacagccagctgttaagacaatcccttcctgccctggctaccttaacaaggactgtcagcatggccattttgaatcttctataaagtctttgaggaaaccacacagctaatggctcagccaggattgtttctgtcctctctctcctcccccagtggagggtggaacttcccatagtccagtagcaggaagatgtgttatcactgatgccaaagggacaatattatgattggtgcaaacacaagtcttcatttgcacgagtttgctgtttgctgtgtttggtgcaaacaccctttgctggctgtaaagcagaaagtttggctcacttgggtcagctgggacaaaccttactatgctaccctccacaatgtcaccacattaggtccagtaacaggaagacagtggctaagagcccgccaactaggtcactaggagagttcctggaaacgcttcaaagctaaaggcccaggtaccgcactttctggagctacagttcgtaataagttaccagagccgaggaattcccactcctctctgatttatacaaaacccgccggcctgctgcttagggctgccaaatgcggagggatcaaaagctaccaagccccagcccagagagcttatgcgatgagcaggacacagccagctggttggcaacactgatacttagtgttactttgtattaatattaagtgtccttaatagggaaagcccgagcttgtgtttatgtagcaaggcaacaggacaacacttctgctatatgtaacatctcaaagggaataccacatggggggagggggatgtccaggctgaataatggaactgagattattctgctgctctagttagcaagaattatggaaaggtgcataacctcaaaccccaccatttatttagcacctagacagaatgtaagcctccatctttcgatataattttgggtaaatcctgcctattctctgcacgactgtaatgggcgtggtcacgtgtccccctcccctccagcagaggcctgagttagccgctctcgggtcaccttgactacgaggctaaggaccccgtgagaaacgcttctcattcgatcgcggagtcctccatgcccacagagaggtgcccagggagaagcctggcgtggcaaacaaaactaaagtagagccgaccgtcggagggtgttgcataagcgtagaagaacaaaatggagagctctgcgggggaagacgtgagtttcctgtcgcgctcttgctactggcgaccggaggaggcgtcgtcagaagcttcatttcaagtgggcgttctgcaaagccagccgcggagcgcgcgcggcgaaagcctgcttccggctccttgcgcgtgcgccctggcggccgggaaggcgggaggccggggcgagcctggaaccggaagtgaaggcagcttcccgcctccgtccccgttgctgccgccatacacgctcgcagtgcttaggtaagctttggccctgtgcaccatccaccgccatctgcttctcccgcggctcgccccgccgcgcgggtccctgatacccggtgccgggtcggcgccgtggccgccggcgcgcaggcgggcgtccagttctgttgtcttcacccctttctgagagcagatcttggcggggagctgggagacaaggggggaacgatccaaaatggtggcctcggccgccattgtgtctccgcgcttcctgggtgttccagtgggtcctctgcccacccggggccgcggcggccggaggcggcgccaggaggagggcggggcccctcgcatctcccctccgggccttttcttgctcgcccagggatgggaagatctcgctccggggcccgtccagccctttgaccccgctttcgctgccttatttggagctctctgtgaatggctgcctctgtgcgtggccgatggtgtcgcgcacttctggggaagcttttccgagagcactgcaaggcgttcctttctaaggccacccagctcacactcttaatcctgcatcgttctcagctgtgaccttaattccttagtgcgactttttaaattaactttggcagcgctgagccgaaccttgcggcctctcgcgttactaagcaagcactgccattgaactgcacacacccatctttttcaaaacaaaaaaaaaatttttttttcttgaaatggagccattcatacacttcccactctccgccccgcaccaccctccttcctgcttctgttccccggtccaggtgtgcgccgctgggacggccactcgggggtttctgagcaagagaatagcggcagccacatgatgtttgcatttgggaagtgagcgctctgcgcagtgctgacccttatctatcacccttgactgatggctgacgttggggatcaccaccgtgaggtggcaggagaaagcgcagtctctgtcttcccttgtcctttgtgtctcaaccctcgtgtgagtcgttagtcacgcttattttactgcggtctcccagttggctcctgcctgtcgaagtgtgtgttacaaagtctggttagcggtggagcccactctgtctctcccgtctggtgttcccgtttcttatgtcatgagactctttgttaactcttctttcgggacaaaggtttcacagtttagggaagaataggacgggtgtagggatcgacgagaagtgacgagtccattcgtgactgatgagtttttccggtttttttgttgtcccctctcccagctcttctgtcggaaactggtgtctttccccttgctgttcttcaacccctctctttggcccttgcttcctcacctgctctgggacacctaactcagagacctcccttctccccctgccggcccaattatggcagagaacgatgtggacaatgagctcttggactacgaagacgacgaggtggagacagccgctggggcagatgggaccgaggctcccgccaagaaagacgtcaagggctcctacgtctccatccatagctccggcttccgagattttctactcaagccagagctgctccgggccatcgttgactgtggctttgagcatccatcagagggtacattttattgttgtgtgtagagaccttatttagcacctctggtgcaagaaaagggaggttcaagtctagggtcataggatttgaatttatttgggataggccaagctctgagaatgtacccaagacggcagctgtagaagaggcttttgttctccattaaaccgagggctgccatttgttctgtgcctggcttttttgcttggtttttgtcattctgactgttcgaactcccagagagggcctggttggacctttagttcccttcttttgggccaggccaagtgtcgtttccggaaaccttaacgatcaggatgctggcttctgtggcttctgggtcaggtaccaagtccttcattttgttcaaggttgcagggttacatgacccaaaagcacagcaacctatgtaggagaaatggcctgtggcagtcgaattcatagattgttacggtgtaagaaaagtaagtttagccaggaacgtggaaggtggcctgttggtagcttctcgagggttctttcttagcggaactggggagctggggtaggagggtttgacttgagtgtaagagtgatgagggtcagggaaaggatggggtctgaaaggtgacaaggtgacatatgatgagtcggctggggagaaaggggtttggcatggtgcaaaaatgtctctcctttctccttctagtccagcatgagtgcatcccgcaggccattctggggatggatgtcctgtgccaggccaagtcaggcatgggaaaaacagcagtgtttgtcctggccacactgcagcagctggagcccgttactgggcaggtatgttgggggcagtgctggagagggtgtggagattgaatcaccaggaggccatttctggctccatgtgctctcagctggtgtcctctgcagttcaaggggaatgttcaccaacatcactgacaagttgctggatgctcttgtgacgaggggctgactttactgtgtctgtctccatttgctccctcaaaggtgtctgtgctggtgatgtgtcacactagggagctggcttttcagatcagcaaggaatatgagcgcttctctaagtacatgccgaatgtcaaggtaaggggggaaagaaacctgggacaggaggctgtggggagacaggcactgggagggaggttggctgtcctcgggcatccctgtgctgtcagtggtgtggtcacatgagagacttcagttagtgccacacccttctgtggctgcccttccaggttccatactgtgaatacacctgtgtgttcctgagagttcgtagctttaggtgataccaccgcaacactttgtggttagttggttttggtattgcagattccattccagagccttgagctactatgtgtgggactgagccacccctgggtcctttgtttttatgttcacgactgtctcttaaccaccacgttgtcctggtaggccttgaactcaccttagtctagagatagtaggccttgaacctgaggctcctgccacaggttcctgagtagttggggcaggcctttgccacctggcttggccagagcctctgttctgttctcctgaattgcttggtagattgtttgagagttgggttgtatgtggcaagaggaagctagatgctcttaaaacagccctggtgtggactttaactctagagtggttaaagctttccgggggtcataacaagtggcctgtgtcctctgtgaaggaacgtggtgtggcctcacagttggcatcctttggaacttttgagattatatatttccatgcttgggtgagtggcctgctgggtttgaaaggccttgtaagctggccctgtgagtagagagatgtgtgcagacttcctattctggttagggtggggaaagagcagcttggatcagtctgggctgacctttgagtcaaatccaccttcctctgcctctactgggattaaaggcgagcatctccacaaccgcccagcatgacagatttaaaagggggaattctagaagaagaaaaggaaaggcagtatgtgcaaaatgctaaaggaggccagagatcttgtgatctctgaggtttccattgctcggcataaccaagcattagacattgttttcctaacctgtctgtgtgcaagcttactggcctctgaaacattttagcgtatttatatatctttttcctaggattttgaaaatagattgtaatctggaggcattgtctatgtctgtgtgcctgtgcctctggctgtatgtcattataccttgccaaaaaactaatagactttcagttccttggctgacccttccccttgtggtggatttaatagttgggaactgaagctggatcagtggctcattcctgtattcccaaggcctgggaggttgaggtgggcgtttgctggagttgaaggctgcccggggctaaggtctcaaaacaaagagggagggtggcaaagctgcagtccttctctgcaggtcccacagcacccttgtgctactcaaaatgctctgagagttgggatcaagtctgaggttgggtttggtgtaggagcctgcagattagctggttaggtcccccccccccatcataaaatcagaatcatctgtacttctccttggctgtgcagcacagtgtcctctagggggctgtctagtccctcccttagttttagctcgcttttccctcagtatttgtaactatgtctgaaagcttaactgataccagtaaaccatcgtgaacaggagtggagtgctcctgtgtgcatgtgttagccattgtggttcaggattgagaagaggaagaggtttactgtagagtaagcgtcctggttatttctttccccttgaaattggacaagtccacgtgtcacagctcacacatccagcactcacctggtgtcacagctcacacactcacctagtgggttgcacatggtgtgacttttatctcaggcaccgaggaagcaaaggctccaggccagggagactgtctgacagttcagttaggaaagcttgcttgtggtttgatcgttgggtggcgcctcacacttgctggtggcttcttgctttcttcatctgtgtaaggaagctgtgactttggagtcacacgtgcctcgttgtgtagatcagctagggctgtgcagagcgatcctgtcttggagtttgagtggaggcggagaagctgagtgttcatcccttcctccatccctcttggccccctggtgctgaggaggtcgctttgtttcttatgggaggcacaggagtcactgcaggcctgaaagctaagagttggtttacagtcaaccacagaatggacacactggtattggcaagatggcccactgcctttaatctgtacttggtgccagacaggctgatctacaaagtgagttctaggccaaccagggctatacagtgaggcctctcaaaccaaagggatgggggagaattctgggagactggaacattgtcctttctcgtggttgacaggtggcagtgttttttggcggtctgtctatcaagaaggacgaagaggtgctgaagaagaactgcccacacatcgtcgtggggactcctggccgaattctagccctggctcgaaataagagcctgaacctcaaacacattaaacactttattttggacgagtgtgacaagatgcttgaacagctcggtgagtggcggtgcccaggccgcagctcaggtggtttggggagcagccctttgagccaaatgatgtatgtttgacataggagcacttgtgtgcaaggacgacccttatctatcacccatgactgatggctctgggcctccttctcttcccctggtgctgtacagtgatgcggtgtgctcagccctgcgctcctttctgtagcagggaacggaatgtgctgacgctacaagtcctcaccaccaccctctccttagggatggaccatgtactgggtgttacacaagagcagcaggtgcctgcccttgtatcccagtatagcatgcgtgataaggatgaaatttcattaagagtttctttggggagtgctagagaaatggctcgttagttaagagcacttggctgctcttgcagaagacctcgtttcattcccagcatccatatgaaagcatataaccactatacatagctccggtttccaggggtgcctgaaaccctcctttggcttttttgagcactaggtgcattcgtgttgcttagatgtacacggaatgaatataaataataacataacggagctccgggtgctagttttggcacatgcctttaatccaagcacttcaagagtctaaggcaggcgagtctctgagttggaggcccatctggtctagagtcagttcaaggatatccaggactacacagagaaattcttgaaaaaaaggcttaacctgcctttaatcccaagggctacatatcgagctcttatctttaaaagaggtgggggagagaattgattctgttgagttgggagagtagaaaagagtgtagctctagagaaaagtctttacaaatggcctttgactgtctcaagatggcactctggtggcattagatcggctgtatatgtctcatggaacagggtatgtgaggcgagaggtgaaggtggaaggcacagtggactggtgtagagattaagttctgagatgggcgtagggagagcagcaggaaagggccttcagcggtattttcttggagactgtatgtatgtatgtatgtatgtataggtcttcttgtgtagaactagttggactggaaattatgttagaaaccaggctggcctcaaactcagatttgcttacctctacctcctgagttctgggattacagatgtaagtttttttttttttttttttttttgagtcagggtttctctgtagagccctgtctgtcctggaactcactttgtagaccaggctggcctcgaactcagaaatccgcctgcccctgcctcccgagtgctgggatcaaaggcgtgcaccaccatgcccggcaagtttattatttttaagtgtgtatgtgtgcatgcatgcttgtgcccatagaggacagaggagtgaaccgccctggagctaagttacaggcaatcgtgggaactgggaagctaatgtggatctctgtaagagcagcaagtgcccgtggctgctggaccgttgtccagcctcatactccatatttaagggcttctgtcccctgagcctctcgtgaactttttccccactttgtagattcggtcatatttcttgtcaaaacaagagtggaacttgaccccaagtctttttctaagcacattctttattccatgctgttactagtatacacagctcctgggcctcctaagtgctgggattacaggcatgtgccacgaagcctggctcgttcctgagatcatggaaccgccacatctctgcagtggctcccctcagagtttcattggcctcaccagacttatgtcacagactcacttcttactgtgtgtgtgtggtttttttctcccctgcagacatgcgtcgggatgtccaggaaatttttcgcatgaccccccatgagaagcaggtcatgatgttcagtgctacctgagcaaagactggtcttgtgggtttgaggtcttgtgtccatgcagctcagaggccaggatgttcagaaattaaggcctagatgtacatgcagtcaggttgaagggcagaaaaaaaacattgtgaaaggatatttgggttggagtaagggacggaggaattcctttagaaattctgccaggtctgggaggtggtagcacatgcctttaaacccagcattcaggaggcagaggctggcagctcttaagtctacaaagtgcaatgcaggacgccaggactacacagagaggggctgccttgaaaagcaaaaagccaaagttctgccaggtgtgttagcagacatctttaatcccaagcagtgggcagagactggtcgatctctgtgagtacaagtggggccagcctggtctcgtgtttcaggacgactagggcaaatagagaaaccctgtgtcaagctttctgctctccagagaatgcacattgagttcatagccctgtccatgtaactggccccagggcatcaacaaacactcctgaaagtgcacttgccagacacccacaaaaccacacacacagaaatcttcaaaactccaaaaatcagatttctggggctggggaagtggctcagaggtcaagagcacttttgttcttccaggagttcccaagttcatttctctatgtcagctcccagtcatgtagttacagtggcggaagaagatggtccaatgtcctctgctggccctccaggcaccaggcacacatgcacaagtgtgtgtaggcaaaccccacacacttgaacttaaaaaaacaagactgataagctggtgcatacatcatgcccgtgctccctcaggtggtgatctttgtgaagtccgtgcagcgctgcatcgccctggcccagcttctagtggaacagaacttcccagccattgctatccatcgtggaatgccccaggaggagaggtgggttggaggcgcgtgcgtgcctgcccgtccatctgggtcctgtcctgtggaggaggcagtgtggagagaagagagtctcaaccctctcatttactctctcacaaaggctctctcggtatcagcagttcaaggattttcagcggaggattcttgtggctaccaacctgtttggccgaggcatggatattgagcgtgtgaacattgctttcaactatgacatgccagaggactcggacacctacctgcacagggtaagctgcccgcccaccccacttcccgtgtgtgctgagcaccccccctctcctttgtcttccctgggaggcttgcagtctaacccttctccttccaggtggccagagcgggccggtttggcaccaagggcttggccatcacatttgtgtcagatgagaatgatgccaagatcctgaatgacgttcaggaccgtttcgaggtcaacatcagcgagctgcccgatgagattgacatttcctcctacagtgagtaccaccctatgtgtgtgtgtgtgtgtgtgcctgtgtgcgcgtttcccattttgtatcttactgtgactttttttctccagttgagcagacacggtagaggactcgcgtggtcagtctgctgtagaagaggacacgggtcaggaggagacactaccgccccacccgacaccgacgcctctgcccaccctatctatgcttctctctgcgtcaccactcctaaacctagtcctgatttatcagagttgtttgtttgtttttgttttttaacaaaactaagaatgaaacaaccgtgtctgtgttgtctgtaagtgctctgttcatggcttgaaccagggtcattctgagggccgtgagccgggttgtggggcagcgtcattgtcttctttctaaggtggctgtggacagggaggctgggacactgctggggcccggaggtaaagagagcaagccccacgtcctggtacctcagctccttcagctgagtttcttgtacctcccaggtatctaagcggggcctggtaggccatgcctgagcgtgtgtgcacaggcatgcgcgcgcgcacacacacacacacacacacacacacacacacacacacacacacacacacacacgcatactggcagcttagctgtgtaaagagcctggagtccctagctggactaagtgtcaaccagggcaggggctggaagccttgggaagctgtggagaggtctggcctgccttccctttctgtttttggtctgaggctcagaaggtcataggtgaagcccaggcagcttcttacctcagctgtgcatctgaggtagagcgggcctgttgcaggattatcttggggttcttggcagtgggggggccggaggtgggaggtgaaagtaacagacctgagctgctgctccctggaaccggaaccgcctctctgtagaccttgattgcacttcagggccaggcattgctaaggcaccggcccatgggccccctgcccgctctgacctgacaggctggaacttgtgttgctggcttgagatctcagatccacacaactgcagttgcacccttagcctcagcacaattgggtgttgtgatggatgccatgtgggtgggcgtgcctcagaaggggtggatggtattactccaggtcacttgggggagacacccatttcttcagacatgccccagagcacaggcctctgctctaaggtttgagcaaaagtctcattcataccttctgtgcccctgcctgtacctctctatgcctccctgggatagcaaagaggaggttggtctctgcgccgaagagcttccccacagtcagggtctcatcaggcggaactatacatacagccaaatgcttcagtctccgtttcattctttgtttttattttcaaaatagtttattaagttttgacagcatctatctaaatgcactaagtgtgcattgcctatggtggccagcagagggtgctgggtcccgaggagcaggttaccaggagctgtgagccacctgacttgagagcaagtgctcctgccccttagccctctgctcctgagatcctcatttctgaagagatctggccaccacatcctggtaggaagggatggatgttcacagagaaagccagaagacttgcaaggttccccactcaagacaattaccattagggttccctttgcccagtcacgtgtgctggatagttttatatgtcaacttgacacaagctatgtccatcacaggagggaaccttaattaagacaattcctccataggactgggctgcaggcaagcctgtaaggcattttcttaattagtgattgttggagaagggctggtggtcctgggttctataagaaagcgggactgggcacattcttggaaaggggagggaggatggggaaggaatgtgtgaggaggggactaggaggagatggggtgctgcaaagtgaatacataatggaaaaaatgaaagggcatgatggtgcacgcctttaatcccagcacttgggaggcagaggcaggcagatctctatgagttcaaagccagcctggtcttccagagctgtcagagaaactcaatcacagcggtgggggttgggggagcaggctgaacaagccagtaagcagccttccatggccttcacatcagctcctgccgctaggttccttccgtgttttgacttccttcaatgatggacagtgatgtggaagtataagccaaataaattctctcatccccaagattccttggtcatggtgtttaccacagcaatagaaaccctgtgacatgtcactgtgaggttggtcctcacacagtacagtctccataaaagccctagcaagcaagaggccaatgtctaacaggagagtccaagattcaaatcctataatcggtgcaaccccttaactcttccaaaacaccaaaacagctgctgccctcttccaactatctctagaaatgttcttgcaggtggcagctgcagtaggagctaatgagcccccagatctatgtaaaaacgaatcagatggtgaggctggagaggtcgctcagtggttaagagcactggcagctctcgcagaggacatgagtttggttcatagcacacacgtggtagctcacaatcatctgtaattccagttccaggggagggatctgtcaccttgttatggcctccatgggcactccacacacatggtgcacagacatatatacagacaaaatgctcatacataaggtgagatttaaagtctcaaaaaaaaagattcagtgttttctgtgggtaatgttgctccgtggatacagcatgcatatgatgcacagatgtgcatgcaagcaaaacacatacgtagaaataaatcagaagttagagatggttcagtagttaagagcactggctgatcttctagaggagccgggttcaatccccagcacacacagcgcagcttacaactgtttgcaactccagttccagagactcccacatcctcacacagacatacatgtaggtaaaacaccaatgcacatgaaataaaaataattaaaaaacatacttattgagtacctcgtagtagattgaggcatctaagaggctgcacgtctccctggaagcaagagctaacagtgccgatgggcttttattcttttcatttacactctttcattacacactggaaggtgggacagacctgctcacttcagcaccctgccagttaaacagaacccccttctggcagaagcctggtccaagtctggtgaacgtttacaaggaaagcaggcagtcagcaactgagctttatccacaagcactgactctcagatataaactgacagtcgctttatcctgggagcctccctgggagcatccagtgacgtgtgtgtgtgtgtgtgtgtgtgcgtgtgcgtgtgcgtgtgtgtataagagagagaggggggggggccgggtgtggtggcgcacgcctttaatcccagcacttggtaggcagaggcaggcggatttcttgagttcgaggccagcctggtctacaaagtgagtgccaggacagccagggccacagagaaaccctgtctcgaaaaacaaaaacaaaaagagagagagagagagggagagagagagagagagagtgtgtgtgtgtgtgtgtgattgagtgtgagtgtgtgtgagagagaaaaagtgtgtgtgagagagaaaatgtgtgtgtgtaagagagtgtgtgtgtgagagagaaaaagtgtgtgtatgagagagagagagtgtgagagtgtgtgtgtgattgagtgtgagtgtgtatgagagagaaagagtgtgtgtgagtgtgtgtacgtgcacaccagctcttgtctctgctctttggaacagtcctgagctgtcttgtgttcacaatgacccgggaaacgtgctcagaaccctgggccgctgagaagaacctaagccatgttatttgacagcaactgagatgcaagcaagctttgcagtagtttgttagcatggcagctgagttttcaatgctctgccacattaattagttaattaattaacacatcagctcctgccactaggttccttccatgttttgactttctgtcttgacttccttcaatgatgaacagtgatgtggaagtataagccaaataaactctctcgtccccaagattgcttggtcatggtgtttaccacagcaatagaaaccctgtgacatgtcactgtgaggttggtcctcacacagtacagtctccataaaagccctagcaagcaagaggccaatgtctaacaggagaatccaagattcaaatcctataatcggtgcaaccccttaactcttccaaaacaccaaaacagctgctgccctcttccaactatctctagaaatgttcttgcaggtggcagctgcagtaggagctaatgagcccccagatctatgtaaaaacgaatcagatggtgaggctggagaggtcgctcagtggttaagagcactggcagctctcgcagaggacatgagtttggttcatagcacacacgtggtagctcacaatcatctgtaattccagttccagggggagggatctgtcaccttgttatggcctccatgggcactccacacacatggtgcacagacatatatacagacaaaatgctcataca

SEQ ID NO: 1560 - DNA, 1634 bp, Mus musculus
cgctcgcagtgcttagctcttctgtcggaaactggtgtctttccccttgctgttcttcaacccctctctttggcccttgcttcctcacctgctctgggacacctaactcagagacctcccttctccccctgccggcccaattatggcagagaacgatgtggacaatgagctcttggactacgaagacgacgaggtggagacagccgctggggcagatgggaccgaggctcccgccaagaaagacgtcaagggctcctacgtctccatccatagctccggcttccgagattttctactcaagccagagctgctccgggccatcgttgactgtggctttgagcatccatcagaggtccagcatgagtgcatcccgcaggccattctggggatggatgtcctgtgccaggccaagtcaggcatgggaaaaacagcagtgtttgtcctggccacactgcagcagctggagcccgttactgggcaggtgtctgtgctggtgatgtgtcacactagggagctggcttttcagatcagcaaggaatatgagcgcttctctaagtacatgccgaatgtcaaggtggcagtgttttttggcggtctgtctatcaagaaggacgaagaggtgctgaagaagaactgtccacacatcgtcgtggggactcctggccgaattctagccctggctcgaaataagagcctgaacctcaaacacattaaacactttattttggacgagtgtgacaagatgcttgaacagctcgacatgcgtcgggatgtccaggaaatttttcgcatgaccccccatgagaagcaggtcatgatgttcagtgctaccttgagcaaagagatccgcccagtctgccgcaagttcatgcaagatcctatggagatcttcgtggatgacgagaccaagttgacgctgcacgggttgcagcagtactacgtgaaactgaaggacaacgagaagaaccggaagctctttgatcttctcgatgtcctcgagttcaaccaggtggtgatctttgtgaagtccgtgcagcgctgcatcgccctggcccagcttctagtggaacagaacttcccagccattgctatccatcgtggaatgccccaggaggagaggctctctcggtatcagcagttcaaggattttcagcggaggattcttgtggctaccaacctgtttggccgaggcatggatattgagcgtgtgaacattgctttcaactatgacatgccagaggactcggacacctacctgcacagggtggccagagcgggccggtttggcaccaagggcttggccatcacatttgtgtcagatgagaatgatgccaagatcctgaatgacgttcaggaccgtttcgaggtcaacatcagcgagctgcccgatgagattgacatttcctcctacattgagcagacacggtagaggactcgcgtggtcagtctgctgtagaagaggacacgggtcaggaggagacactaccgccccacccgacaccgacgcctctgcccaccctatctatgcttctctctgcgtcaccactcctaaacctagtcctgatttatcagagttgtttgtttgtttgtttttgttttttaacaaaactaagaatgaaaaaaaaaaaaaaaaa

SEQ ID NO: 1561 - DNA, 1287 bp, Mus musculus
atggcagagaacgatgtggacaatgagctcttggactacgaagacgacgaggtggagacagccgctggggcagatgggaccgaggctcccgccaagaaagacgtcaagggctcctacgtctccatccatagctccggcttccgagattttctactcaagccagagctgctccgggccatcgttgactgtggctttgagcatccatcagaggtccagcatgagtgcatcccgcaggccattctggggatggatgtcctgtgccaggccaagtcaggcatgggaaaaacagcagtgtttgtcctggccacactgcagcagctggagcccgttactgggcaggtgtctgtgctggtgatgtgtcacactagggagctggcttttcagatcagcaaggaatatgagcgcttctctaagtacatgccgaatgtcaaggtggcagtgttttttggcggtctgtctatcaagaaggacgaagaggtgctgaagaagaactgtccacacatcgtcgtggggactcctggccgaattctagccctggctcgaaataagagcctgaacctcaaacacattaaacactttattttggacgagtgtgacaagatgcttgaacagctcgacatgcgtcgggatgtccaggaaatttttcgcatgaccccccatgagaagcaggtcatgatgttcagtgctaccttgagcaaagagatccgcccagtctgccgcaagttcatgcaagatcctatggagatcttcgtggatgacgagaccaagttgacgctgcacgggttgcagcagtactacgtgaaactgaaggacaacgagaagaaccggaagctctttgatcttctcgatgtcctcgagttcaaccaggtggtgatctttgtgaagtccgtgcagcgctgcatcgccctggcccagcttctagtggaacagaacttcccagccattgctatccatcgtggaatgccccaggaggagaggctctctcggtatcagcagttcaaggattttcagcggaggattcttgtggctaccaacctgtttggccgaggcatggatattgagcgtgtgaacattgctttcaactatgacatgccagaggactcggacacctacctgcacagggtggccagagcgggccggtttggcaccaagggcttggccatcacatttgtgtcagatgagaatgatgccaagatcctgaatgacgttcaggaccgtttcgaggtcaacatcagcgagctgcccgatgagattgacatttcctcctacattgagcagacacggtag

SEQ ID NO: 1562 - DNA, 53106 bp, Homo sapiens
atcttttattatcacttatcaataaactgagtaaaataaatgttttcaggggaatttctctcagccagccttaccaggggatgatgggagaggggtggggaggtgaaccggcaacaactatggccggcggcagagcaagctctttccaaatgactgctgacctagggcaggggaaagggagtggagtgtgacagagggtctcacccatgggctgagagaaaacaggagaggaaccgacgttcctgaactccccttttcttcagtcccaaccttgctgcatctggcccaaggttagctgagtgccatgctacttccttcactgccaacccaggcatcctggccaggcccacctgctgtggccaccaaccacctctttcacttgggggatagaagaaggggagggaggcagccttccttcctgtggacctactttctttccccggggtaagaggaaatgggctagcagtccttaaatctttatttggtagtgctggaaagtactgtttacctggcagaaagctggaataggggaaggcaaggccaggaaggcaagaagacagaatggcccaggtgtggctggcgaaggcccaccatccctacccaaatcacatcagggttggtggggggggcacttctccctagtgctgctgtgacctgtcacagaccctctcaacttgtcccacccagaaagtacctggtcctgtctctcattcgcttgttccccacctgagctcaggtggtgagcatggtgagtgctcaggcttgcatgggaggtttacattcataggttttaaggagtagggcctccaactataaaaacataatattaaacagccactacaactgaggcatgtgtttgaaaaaagctggctacaaaactgtagagaggatcagatgtggccaggcacggtggctcacgcctgtaatcccagcactttgggaggctggggggggggacaatggatcacaaggtcaggagttcaataccagcctggccaagatggtgaaaacccgtctttactaaaacaaacaaacaaaatatatatataattatattttatattatatataaaattagccaggcgtggtggctgacgcctgtaatcccagctacttgggaggttgaggcagagaactgcttgaacctgggaggcggaggttgcagtgagccgagatcgcgcctctgcattccagcctgggtgacagggtgagactctatctcaaaaaaaaaaaaaaaaaaaaaaaagagagagagagagaggatcagataataactgtctaaaacaagagaccaaatcctatggttggaaaaaaagaggccgggcgtggtggctcatggcctgtaatcccagcactttgggaggctgaggcgggtggatcacctgaggtcaggagttcgagaccagcctggccaacatggtgaaaccctgtctctactaaaaatacaaaaattagccaggcgtggtagcatgtgcctgtaatcccagctacttgggaggctgagtcaggagaatcacttgaacctggaaggcagaggttgcagtgagctgagatcatgccagtgcactccagcctgggcaacagagggagactcccatctcaaaaaaaaaaaaaaaaaaagaaaaaaaatagactggcaaaaaatatgtaaaaattctagcctatgggtggtggggctgtaggtggcttttcccccaattttatttgacattttaatgtgaaagggatataattaagttgaaattttctttttaaagaaggacgaacaaatttgataactattaacagtgtactgtgatcccttccagtcccaccttggtgtacctaaaagcatacatatgacacatttatttggagatatgtaaccatactacaaatattgcttggcaacttgcttctttcatttaacatctcatttatatttttccacaggaatatatacagtctacctcatactttttgacgactttataattagtgttccactgtgtgtacaaaacaaatctccttaccccaatatcgatagactttgtttcaaaaaatgttcagcctcatgagtatcttacagtctttctgtgggggtagattttcataagtggaatttctgagtcaaaggacatgcgcaatttggtcaaactgctctcaataagtttgtgccaatatacaagtgtgcctatgtcttcctttaccaaaattgaatatcatcaacccttttaattttgccagttggatagattaaaaaattattttattaacaatgtttttttctttttcatgtcttttggctatttgtattttttgtgaatgaattgctcatattctttatccactttttctttggaaattatatatattgatatgagggttctatatactgtatgtgttatacatattgcaaacattttcttctatctatctttaaaaaagctttttttttctttttgagacaaggtctcaccctgttgcccaggctgcagtgcggtggcatgatcttgctcactgcaaactctgccccacctgggctcaagcgatcctcccacctcagcctcctgagtaactgggactacaggacgacagccacgtaccaccacgcctggctaattttgtattttttgtacagaccaggtctcactgtgttgttcaggctggtcttgaactcctggctcaagtgatctgcctaccttggcatcccaaagtgtgggattacaggtgtgagctaccgcacccggcctaaaattttcatgtagttaaatctatatcaatatattattttctgactttttatttcacttcactcttaggaaggctctattttaagattataaaacattctctgcattttcttctactactttagatgtatactcatttttatttttagaaattaaaaaactcggccaggcgcggtggctcatgcctgtaatcccagcactctgggagcccaaggtgggtggatcatgaggtcaggagttcaagaccagtctggccaagatggtgaaaccccgtctccactaaaaatacaaaaattagcctgacgtggtggcggatgcctgtaatcccagctacttgggaggctgaggcagagaactgcttgaacccgggaggcagaggttgcagtgagccaagattgcgcgactggactccagcctgggtgacagagtgagactctgtctcaacaacaacaaaaaagaaattaaaaaactctcaaaaatacaaagtataatacaatacacaaccccattcctaccacagggtttgttaatgtactgtcatgtttgtagtataatttattttaaggaaataaaatcatcacagataaaggtagtttaccgtgataccgccttccaagtttcattcctccccaggccatctgtcccatgaatttggtgtgtaccttcctgtcatattcaggtatttaatctgctggaatttactttttgattaggtgtgaggtgggactcttgtttttccctagatgagccaaatgttccaatattatttataaaatagttcacctggtcaggcacagtggctcatgcctgtaatcccagcactttgggaagctgaggtgggtggatcacctcaggtcaggacaggagtttaagaccagcctggccaacacggtgaaacccccatctctacaaaaatacaaaaattagctgggcatgatggcaggtgcccagctactcaggaggctgaggcaggagaattgcttgaacccgggaggcggaggttgtagcaagctgagattgcgccattgcactccagcctgggtgacacagcgagactctgtctcggaaaaaaaaaaaaaaaaagttcacctttctccagtattagaaatgccccctttaggcctggcgcggtggctcacgcctctaatcccagcattttgggaggccaaggcgggcggatcatgaggtcaggagttcgagaccagcctggccaacacagtgaaaccctgtctctactaaaaatacaaaaaattagctgggcgtggtggcgggcgcctgtaatcccagctacttgggaggctgaggcaggagaatggcttgaacctgggaagcggagcttgcagtgagccgagatcacactactgcactccagcttgggcgacagaatgagactccatcccccacttcgccaaaaaaaaaaaaaaaaaaaaaaaaaagaaatgccgcctttatagcgatttaccagatcaaccgttctcaatgctctttaatacgctggagtttcatactaagaaaaataaacataaaaacattttggccaggcgctgtggctcacgcctgtaatcccaacactttgggaggctgaggtgagcagatcacaaggtcaagagatcgagaccatcctggctaacatggtgaaaccccgtgtctactaaaaatacaaaaaattagccaggcgtggtggcatacgcctacagtccctacgcctatagtcccagctacttgggaggctgaggcaggagaatctcttgaacctgggaggtggaggttgcagtgagccgagattgtgccactgcactccagcctgggcgacagaatgagactccttttcaaacaaaacaaaacaaaacagaaaacaaaaacaaaaccaaaagacattctgtgggatgggcacggtggctcatgcctataatcccaacattttgggaggctgaggtgggtggatcacttgaggtcaggagtttgagaccagcctggccaacatgttgaaaccccatctctactaaaaacacaaaaattaggtcgggcatggtggctcatgcctgtaatcccagcactttgggaggccgaggcaggtggatcatctaaggtcaggagttcgagagcagtctggccaacatggtgaaaccccatctctattaaaaatacaaaagttagtcgggcatggtggcaggctcctgtagtcccggctactcaggaggctgaggaaggagaatcacttgaacccaggaggcggaggttgcagtgagtcaagatactgccactgcactccagcctggggaacagagggagactccgtctcaaaaataaataaacaaataaaaatttaaaaattaataaataaaaataaaaaaattagctgggcatggtggtgtgtgcctgtaatctcagctacttgggaggctgaagcaggagaatcgcttgaacccaggaagcagaagttatagtgagccgagatcatgccactgcactccagcctgggcgacaaagcaagactccgtctcaaaaggaaaagaaaaaggaagctggaagctgaatgagatgggcctttcaaccaaggagttagaaggccatctggtggcagggctggcagaggaccaggagtaaataaggccagagaggacaccagggtctgggagtgaaggcactgagcttgggtccccctttggaagacaatgacctgagagctgtgagatttcagacaagttcccgaaccttttgggccctgctttcctcatctgtaaatgggataatatcagtctcaccagcttcttaaaattcaatacaatggagttgggtgtggtggctcacgcctctagtcccggcactttgggaagccgaggtgggcagactgtttgaactcaggagatgcagaacagcctggataacatagcaaaacagtctctaccaaaaatacaaacaattagctgggcatggtggtgtgtgcttgtagtcccagctactagggaggctgaggtgggaggactgcttgagcccacgaggtagaggctgcagtgagccatgattgcaccactgcactccaggctgggagacagaatgagaccctgtctcaaaacaaacaagcaaacaaacaataaaggaaatccctaccacactatcaggggcattttggctgagcgcggtggctcacgcctgtaatcccagcactttgggaggctaggctggcaggtcacctgaggtcgggagtttgagaccagcctgaccaacacggagaaaccgtctctaccaaaaatacaaaattagccgggcgtgatggtgcatgcctgtaatcccagctacttgggaggctgaggcaggagaatctcttgaacccaggaggcagaggttgaggtgggctgaaatcgcgccattgcactctagcctgggcaacaacagggaaactccatctcaaaaaaacaaaacaaaacaaaaaacaaaactcccatttttgcgaggcaaattgggctcacagaggtaagctgcatgtccctgttgatggcagagctggggtctggatgcaggtctgcttcggggtaatctgctcttttgccttccagggtcctgcctcttacaatatgagctgtcaagttagatgcctgcactcagtaaacctactctgttttaagtaaaaacaacaagaaacaaatctgaatatgctagcctatctcaggtacgttaaaggaaatttttaaatagggggttttttgaccatttgggggagttttgggggaggggccttctgtctatacttgagctgggggatgttagggttgttcatctggatctagaggttttcctgtaatgttcttactccagaaggaaatctctagatggggaaagaaggtttcagcttttattctagtaagcagggctctacctataaagagctgcttccaccactcttttttttttttttgagacggagtcttgctgtgttgcccaggttggaatgcagtagtgcaatctcggctcaccacaacctctgtcttccgggttcaagtgattctcctgcctcagcctcccaagtagctgagactacaggtgtgtgccaccatgcctggctaatttttgtatttttagtacagatgggggtttcactatgttggtcaggctggtctcgaactcctgacctcgtgatctgactgccttggcctcccaaagtgctgggattacaggcatgacccaccgcacctggcctccaccactattataatatcaccaggttccccatttgaatccttcagtgccaaaggttttgcagaattcaaatgtttttgggacttgatagggctgacctaaaagtacactcactctatattaggtagcccaggagggcctaggcagcccaagaaccaaacacatgagtgtttctgcagggaaatgtatgaatattgacatcagtaggatgaaaataaataatagtcttactttagttcagattaggtttctgtcaccaaatgaattttggtggcagcctgatgaaaaatgttggttctcagagtgtttttgagtttagaattgtggttaagggagtatggacctgttgataacaaaaacaggaacaaggccaggtgtggtggctcacacctgtaatcccagcactttgagaggctgaggttggtggatcacctgaggtcaggcattcgagatcagcttgtccaacatggcgaaaacccatctcttctaaaaatataaaaattagctgggcgtggtggcatgcgcctgtaatcctagctacttgggaggctgacgcatgagaatcacttgaacctgggaggtagaggttgcagtgagccaggatcgcaccattgcattccagcctgggcaagaagagtgaaacttcataaaaaacaaaaacaaaaacaaaaaacagagaaacaggaacaacaatcgccagcatataccaagtgcttatcgtgtgtgccaggtactctaattatgtactatgtcagttgattctcaaaacatatatggcacaacatgggtactctgaacatgggcacaatcaatgtacaatgctataatgtataacacaggacaatgtagctgttaaaagcatggacactctatctagtccatctgggttataatctctgctctaccagtgaataactgtaactctggcaaatgacttctctatgccctgtttcctcagctgggaaatgggggataatatcagtactcacctcctaagattgttgtgaggattaaatgtgttactttataagaaatgtctggcacatagcaaaggttgttattattttaatttttacacatgggcaaactaagcctcaagtaacctgtccaagaatacgtagctatgaagtgtggagctgggatttggagctggggtttgaatccaggcaatctaactccagagcctaccttctatgctactttttggctacgagcaaacaatctgtcaagaaacaaagtagctactaatctaaacagatgtgaaatttgaagaccagttgatctttggggaatgttgggttcttcagacaatggtagctcagtaatgtaaagggacaaatgacagccacatgccaacttggttaactccttccctaggtcctgatgaccaaataaccagcttatttctcaactattggttggctttcatttcaggtctggtcagctgcttatgaccttgttccccactgagcagactcaccatctgggccctggcgggcagcagcatgcagtgccgtgtccccatggcggtcctggtgggcagggtcagccccgagccgaagcagcaggcacagggcaggggcatcgtggcgggcacaggcccggtgcagtggtgggggctgcccagcatctacatcgaggcctgggtgtcgctggaggagggcctgggcccggaccagccgtcctgcagacaagtaacgacgaaagcgacgttctcggcgttggcggcgggaagtggaggccatggaactcttgggctggggaaggaaaaaaggcagcagtcaggacttcagccttggctggtccttctccctccatctctgacatcccctgttgtttctccctttggttccgtctttttttaatatcttcagcaagagatgaggcctaacctaaccctgatcctttatcagatgatagatttgaaaaaaaattttttttgaggggggtgataggatcagaggtttaatttttttaatgtaaaattcgagaaaagggtaaataattggtttaaggctcaggagcccaggtaaatttttaatttttaacaaagaactttaaaaaaacccaacagggccggatggggaaaatttttatcagcagaaatctgagttttaaaaagtcacagataatctccaataatgatctagaaattgaatatcatgtacccggcagacagatgtggaggcttcttcctctggaacctggggggaggggttactcatcagacctgcccccgcccccccaagtacccccagagccgtaggcccaaggcctgtgtttaagaagctcggagacgggaggcgggaagggcggagacactccaggctggaggaaatggcgcaagcagagacgcaggtggaggacggaagtgaactgtgaggggcgttaccggatgtcgttccgccccgaccgggtagttcttggccagatctcccaggggaaactagggaacttaaattaaaggggccgtctgaaaccagaagactggactggaggcgaggaaaaggaggcgaggggaggggagggagaaaagagagttatttggaggtttttccccgcctcctctaacttggcagagagaggagatggttcagtgatggacgaaaagatgagaagacagagaaaatagaggagataaagacaggataaaaatcacattaaacatggaaaacaaaaacaaaaaccacagtgggacaacaacagggacagatcaaaaaaaagaaaaaatacagacaaaagacggaagaagactatcgtaggatggggcaagtgagatgcaaaaatttggacttgagaaatatgtagaaaaagatggagatgttaacaacgggaggcaggggagggggcgggatggtggagagagagagaaaggtagagagttagtttagaattaagcccagaatgctcttttcccaacacaggttgcatgatgacatccttaccttttcaccgcattcacaaccctttatgcttcctctgttaccaccaatcaagttctccttctctcacctcagtactcccccgtctccgcccctgcctcatccctagacctttccgactgggatggctaacctgttgtaagcccgcagctttgggcctggtctctgctgctcccaggcggcccctttgggtactgcctgagcaagaagtgctggagaggaggaccagtcatcaataggaggatgagattgggagagacactcggtgcaggaggctgagtgagcaggggagcactaagacccaggggtagtggaggactgcagcaacgagctggaggaggagaagtaagcggtggggggtgggagccatctggtactttgacagcattcaaaacagcatcggccataacaacagaaatggccagtcagtcccaaggtatccagcagcttctgcaagctgagaagcgggcagctgagaaggtggcagatgccagaaagagtgagtctcctctttcctcccttaggagtttggaaagaaaattgggggtgggggacagcaaacattttgggaaaacccaaggctggcgggaagacagctagggtctggaggctggttaggagggaagaaatggatggatattagaatctggcacctggttggctgagagaaggctgtataactttctggaagggactgactcctgctattacattgtgtgtgtgtgggtccatccccactcactgtcctttcttctgcctccagggaaggcccggcgactgaagcaggcaaaggaggaggcacagatggaggtggagcaataccgcagagagcgagagcacgaattccagagcaagcagcaggcggtgagttgaggcagagtcgggatgagaccccactgcaagttggtgggtgcatctagtgaggtgtgtaagggtgactcaacaagaaaatatggtggcagagggctgaggctgaggggaccctggcagggaccacaacattggtgaaactttgtgatgatatgtaggagagtctgggagttttgaaggccacatagagcttgtgggcggaatgccacagtctgtgtaaagtataacatctatgtggagtatgattaacatttgtggtggagggtagagttttatggtcatggatggtgaggtggtggggatattacggtctgttttaggatgaagttgcatgttaggtctaaggggaaaggggactgtgttgatctctttggtgttgggatatttctgtgggatgggggtggtttctgagagggcctttcttctaggctttgtttcaggatctttcccctcatatgcctggacccttgtctgtttctgcttttccctttctctcttccacccctctccctaccccccaggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaattggtgagttgaagcagcctccttttgcctcatcatttctcattttcagtcactttgttttttttttttttgagatggagttttgctcttgttgcccaggctggaatacaatggcgtgatctcagctcattgcaacctctgcctcccaggttcaagcgattctcctgcctcagcctcccaagttgctggaattatgggtgtgtgccaccacgcctggctattttttgtatttttagtagagatggggtttcgccatgttggtcaggctggtctcaaactcctgacctcaagtgatccacctgccttggcctcccaaagtgctgagattagaggtgtgagccactgtgcctggccttcagtcactttcttgttttttgtttacatattccctaaacagcccaaatggctatcctttgaaacttcttggagaaacaagaacaagtagtactttattatttctctaaagtgagaaacatggttcctcatttgggaatctgaggactatagatcgcaactgtagagaaaagctggagtgtaggagcaagtgctctttgcccctttaccttgcattttcttcatagcacttactgctactggttttttgagacaaggtcctgctgtgttgcccaggctggagttccagctcacggcagccttgaccccctggactcaaatgatcctcccacttcagcctcctgagtagctgggattacgggcgagtgccactatgccttgctaattttaaaattttttgtagagatggggtctcacttgcccaggctggtctgaaactcctgggctcaagcaatccttcgggctcggcttcctcaagggttgggttacaggcctgagccactgcaccctgaccacttatcgatacttgacattatatttgtgtttatgtgttttctttcctgtaatgtaaacactgtgagaacagggctgttcaccgttgtgtccccagatcctaggacaacatgtggcacaagggaggcagttgataaatacttttgaataaattaaatgatacttgggaaaataccttctatgacaccattcttgaattagttacttcatttgtcactgaagacaagcttacttcaccaagaatttgaaccaataaggtaacctgcagtgtatttactaaccagattctttgagcagggaggcagaatacaatagagaatgagagatgtttgcatcctggctgtaacctcaccagccgtactgcttgagatatgttgctttgcttcgcttctgtcaataagatgagaataacggtacctactccttagtattaaatgattaagtatgttaacagggagagggccaaacgtttgttgttttattacacagcaggacatcaggtcttacttttgtggctccccatctcaaagacggggatagcaaatgtttcattcaggaaaaaaatccaggttgaacaatggggctgttggggcggggccaagaacattctgctcgaattaacagtattaatgggccgggcgcggtggctcacgcctgtaatcccagcactctgggaggccgaagtgggtggatcacctgaggtcatacatgggtgaagccccgtctctactaaaaaaacaaaaatttgctgggcgtggtggcgggcgcctgtaatcctagctactcgggaggctgaggcaggagaatcgcttgaacccgggaagcagcggttgcagtgagccgagatcaggacattgcactcccgcctgggcgacagggcgagactctgtctcaaaacaaaaacaaaaacagtattaatggaatgtagtataaccctcaagccctactattaacacttggggccgaatccagaccccgtcttcccgctcggattcagaacaccttcctgactcactggccctagggcatcagctacctcggacagcatccttttgggaaaataccgcccaccagccccacgactgggaaagagtcgggaaacacccccgagcaatccagttccctgagacttccctcctccctcccctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggaggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggaaaaatggtgaaggctgtgctcgtgattaagtcttgctttttttttcccccctccagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggtaaattttctcttgggcatgtagtgctcattgggctctttaagggtacaatacaaagatgtgtttgtcgttgctcaggtggtggtaagggtttatacttaaggctagatcagggccaggtgcagtggctcacgcctgtaatcccagcactttgggaggccgaggcaggagggtggccacttgagctcaaaagtgcaagagaagcctgggcaacatagcgagactcctgtctctacaaaacgttcagaaattaagcaggtgaaggttgaggcttcagtgagccgtgattgcaccactgtgcaccagccggggcgacagtgaggaagaaaaaatcgggataagtatcaaaaacaattttggatagaggaggcttatacaggcttattctttctttcgtgatagcaccaaagtgctaatgatccaaaagtgacttccaggtctgccattcattcttgtgactggcttttcttgtctgcttatttttaattttgtcacttgacttctaattttaaatttccagaaaggtcctgcttggacctgtagtctccctctgttgggccaggccaactgtggtctctggaaacctctatgactggtttagagatgactggcttctgggtcaggtaccaagtccttcattttgtccagggttgtagtagttacgtgacccgaagtatagcaacctaagcaggagaagtggtctgtggcaggtattcaaatgtcatgaattgttacagattaagaaaaataaggacagagctaggatcattgaaggtgagcggttggtagatgcaaggggtttgttactaggactgggaaggcctagatctggaggaggctaaagctaggaggaattaggagagtctgattttgaggtgaatgtaattgagcagagagaggtaaaatgggtctggaagttggcaagaaccaggtaaatactagactttgagaattgagtggtaagaaatgggcttggcatggtgaaaaaggtagagttatctggagactgaagtctaatttatcttcctccccccccaacttttagtccagcatgagtgcatccctcaggccattctgggaatggatgtcctgtgccaggccaagtcgggcatgggaaagacagcagtgtttgtcttggccacactgcaacagctggagccagttactgggcaggtatatttggggagagtgctggggaggggattttggttaggactataagggaagggtgtttttgtcctaactacatgatgcttgcagagccatgagcacatgacctctgttacccttgacaacctgacagctgtgggggatgttctgtcgcaagcgtggggttcatgatttagatcacagaattgaagtcatttattatcggcccaggtgtgtttttgtgacagtcacttccctagaggggataatgaagagctacatttaccatatgtctccgtatacttcctgcctaaggtgtctgtgctggtgatgtgtcacactcgggagttggcttttcagatcagcaaggaatatgagcgcttctctaaatacatgcccaatgtcaaggtaagccaaggtaaagagacctgagagtgagggtgtggcaagttggagggataagaaacttgtaggccaatagtctctttaattttggagaagctttagtttgctgtggtgtaacagagtgttgagttcctatgtaacaggaggattcgtaattgggctatggatgatgcttaacacaagaccacccttttcttactactttatactgactttgaatcatatcagtttaataattttggggtatgtggcagagaaagccggaaactttaaaacagctccagtggtgtgtgaatattgaggattctggccaagtgcacaatggcttacacctgtaatctcagcagtttgggaggccaaggcgtgtggattatttgaggtcaggagtttaagaccaatgtggccaacaggatgaaaccctctctctactaaaaatgcaaaaattagccgtgcatggtggcacacacctatagtcccacctgcttgggaggctgaggcaggggaatcgcttgaacccaggaagcagaggttgtagtgagctgagattgtgccattacactccagcctgggtggcagagtgagactcccatctcaaaaaaaaagaaaaaatctgattgaagttaagcatttttggcaagaatccttcataggtgatgctgtatctcctgttatgccacaaatctggtcgacttatgttagttattttattttatttttatttatttgttttgagatggagtctcgctgtgtccttcaggctgtgagtgtagtggcgcgatctcagctcactgcaacctgcgcctcccacgttcaagcgattctcccgcctcaaccccccgagtagctgggactacagtgtgccatcatgcctggctaatttttgtttttttttagtagtgacagggtttcgccatgttggccaggctggtctcgaactcctgacctcaagtgatccacccacctcggcctcccaaagtgctgggattacaggagtgagccactgcacctggcctcattaatgattttagatttaccataggattagcgtcgtgacagtctgattccacagttgttcttttcccccttgaaaccagaaagtagtttctggtgttatttgatactgtaccaaggcccagatccccaaacaactattcacctaatggttttaacatgaaatgataatatttagcccgaagcagtaatttcatggggtttgtgtgaaaagagtttgagattctgggtttatttaggaaaccttaatgttccatgtgttttttgtggtactttacactaatctggtgatttcttgctgtcctttatttatttattttttattttttgagatggagtctcgctctgtcatccaggctggagtacagtggctcaatctcgcctcactgcaatctccacctcccgggttcaagcgattctcctgcctcagcctcctggctaaattttgtattttttgttttttagtagtaaatttgtaaattttgtattttagtagagatggggtttcaccgtgttggccaggctggtcttgaactcctggcttcaagtgatccactttccttgacctcccaaactgctgggattacaggcgtgagccactgggcctggctttattttatttttatttattttatttctttttgagatggagtatcactcttgttgcccaggctggagtacaacggtgggatcttggctcaccacaacctctgcctcccaggttctcgtgcctcagcctcctgagtagctggaattataggcgtgtgccaccacacctggctcctttattttttaaatgaagcctggcctcataaatgaaggaagttggttagattaagtcagtagaactgaattattgtcctgactgctccgactagccatgtaactttaggcaatcaccctcagtgtttggtgggggggacataaaatttttaaattaggtgacctctaaagttagttttagtttggaaacatgctaaaaattggtttagctcaaacagagtgggaaccctggggggattggactctttccttcctctgttttgagactctttgcttctggctcggcaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcggtgagtggcagtgctggggcttggctaatgctggggagttgttctttggagccaaatgatgtttatttgaaacaggagcacctcagtgcaaggacgactcttatctatcacccatgactgatggctctgggttccctggttggtctttattatgcttttaagcacagtaaagggtgtcatctatcatctttctatgatttttgtttttaacctttgagaataggggactttgataattttaggcataagtcatcaccaccaccaccgttttcattatagattcatatactgggagtcataggggagattctaaactgaaagagaagacagtacccttctggcatctccagcacagcatttacagtcagaatttatagctgaataagtgtctagactcaggtctgggattaatgtagagagtgtttgtagcagtttgtgtgatgtggtattctagtgtgccaggtggggttaatggaagatttttctgtaagaattgaatcttggtgaatgagagtggggttggacataggccccataagtcattacaaatgatctttggcaattctatatggtgagctataaaggtgggctccaggtagggatgtcatatttgcctgacttgatagaaaagtaatccagagagtcatagatggactctgatatctggaatataatatgtgcttgatatttgtagtctgctgaaggctggctggggcttgggcaggaaagggttgggagaaggtcccataaagcatgttttgaaggccttgagagcctctgcactgggctttatccccatttcatagttgggaactttggggttttaccttatttcttgcttggttaaaacaaacagctggaatctgatcccacttcttgattccaagtccattgctctttccattgtgttgttactatttccagcaatcttcacctcactgggaagtctacctctaatctttgtttatcatacctgcttattttctcctacaatttttttccttgttcttgtagacatgcgtcgggatgtccaggaaatttttcgcatgaccccccacgagaagcaggtcatgatgttcagtgctaccttgagcaaagagatccgtccagtctgccgcaagttcatgcaagatgtaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagggcctgcgcgggtgccagggaaactccggaagacttggtcgggttaatgtgagagcgggtagtgttcgactttttcataaatcacaacatttttgaacctcttctcccttcgggggagggcaggatttttctgccctaccacccacccatccatcgtctcttacatgcaccctacagccacgcaccctcaaggtggcatcgagcatacagctggagccttctgctcaccaaaactcctacttcccggtggcaggagagcaagagagggacagacagatggcagggcatgtccaaaagaagagcatcagcacaaatgaatcctccccttccccacctccaggggtgggggcctttggcacctcaatccccgataccctactccttcccacccacatctccttgcacccatctggaacctcggttgatgtgagccggcaacagagaagcaccgtggcgcggcgagggaatgcagacggcacccagcggtggatggcggcagcggaggccgcggggaaacctgaccaggaagctgaggaccaaaccagcctctttttccgttcccggtttttttcctgaacccaacgcgtgccgtgccccgtttcccccaatatgtgttggggaggggtgtcctgaatggggtggtagattttttttcttaaaaaaatttttttgttttttttaatactcagaggagagggacataggaaaggtaaagtggatgtaatcgggtggttgttagggtttggggctaggtggggccaattgcataagcagtggagtgtgttcttcccctccctgcagtgttccttcccgtgggatgatcactctttagctgtatttggggctagaatgagatttgaaggaggccatggaacttctctttagaaagcctgccttggctgggcctggtggctcacctctaatcccagcactttgggaggccaaggtgggaggattgcttgagcccaggaatttgagactagctggggcagtgtagtgagactttgtctctaccagaaaaaccgggcgtggtggcgcatgcctgtagtcccagctacttgggaagctgaggcaggagggtttgcttgagcccgggacgtggaggtggcagtaagctgtaattgtgccactgtactccagcctgggtgatagagtgagaccctgtatcaaaacaaaacaaaaaacaaaacctgccttctgggattgggcttctggtttttttcccatgacacacacatcctttcctattttgtcctctgggtcttcatattaactatcttcccccaggatagtataaaaagtgttaggaaagttgggctttggagttgtggtaatttctgtctttgttactttcctccccttcagggggttttttaattttaaagatgaatgcagtgaggtataatggtgtgtgcctgtagtctcagctattcaggagactgaagcaggaggatcacttgagcccaggaatttgaggctatagtgtgctatgattgtgccagtgaatagccactgcactccagcctgggcaacatggtgagatcctgtcccttaaaagcgtatctgctgctctgaatttggtattttaacaccacttactgatacctttcctgtaaacctgtagatggtttaattcttagtcaagagaccagtctcatctaaaactatcctgttgtggtctgacggcaagtaactcatcttgagtaatttttgtttctccttaagtggcattttgactgtccattgcagcattctgatcttaaaagacatccactttgctaatgcacacgagattctcttagttgaagtaggagaatcaaatggagcagttgtcctccccccaccccatgttcttagaagcacctctgatggagttattctgaccttgagtcactgcctcccatcatttcccagatgtttggtccttgctctccctttgagaatcatctcccattttctttcctctcccacctctatttgaggtaatggcatctgtgccattgggtggtttcactgctccttgacttcatttgcagtttctttcccatgatagtttttagttgggcagtcttaaaactcatctgataggaaggaaattagatgtaatgtgagagagaccacagtaaaatgtgggtatttttgggagtggggtggggttttcaatcttctctttcctccccatccccccatggggtgtattggagatcaacttcctccacccccccaggtttaacccccccactctgccctcctcccgttccccacccccttcctcccccccagccaatggagatcttcgtggatgatgagacgaagttgacgctgcatgggttgcagcagtactacgtgaaactgaaggacaacgagaagaaccggaagctctttgaccttctggatgtccttgagttcaaccaggtcagttagacgtccagtagggggatgagcattggagcactccagctgtagcagaaacctggatattaagtacacttttattgaggaaatcacatgtgtgatgtgggagagaataatgagggtataaatatcttaggggctgagcatgagtaaggtgggagctgcttttctattctatggctggcacgggtatgtcctcaataacctcaaggaaaataaacttcaaaaattaagatccttggccaggcacggtggcttatgtgtgtaatcccagcacttggggaggctgagggaggtggatcacttgagtccaggagtttgagaccagtctgggcaacatggcgaaacttcatcactaccaaagaagaaaaaaattagccaggtgtggtggtgtatgcctgtagtcccagatactctggtggctgaggtgagaggatagcttgagcccaggaaattgaggctgcagtgaactatgattgcactactgtgctccagcttgggcaacagagtgagatcttgtctccaaaagtccttgaaggattttaggaagttgttaaaagtcttgaaacgatgtttgggggcatgttagggttcttgaatgtttaattcctctaataactgcttattcaagagaagcatttctgactgggtgcagggcagtggctcatgcccataatcccagtactttgggaggctgaggcaggagcattgcttgagcccaggacttcaagaccagcctgggtaacatagggagacgcccgtctctacaaatagtaaaaataaaaaataaaaaaagtagctgggcgtggtggtgtgcacctgtggtcccagctgcttgggatgctgaggtggaaggatctcttaaacccaggagggtggaggctgcagtgacttgcgattgcaccactgcactccagtctgggggacagagtgagaccccatctcaaaaaagtgtttaattaatatacttgtgagtggtctatttgcatttaaaactgctttctagaattaggatagctcccttaggtttaatgttttggtgagcaggaatatcagttacccctccagatcttaattctagttttttatcactttttcatgaggtgatctcatcctcatctcctagcatgtctggcaattttgatttctgaactctgtgctacctcagaggccagcttccttagggaaaaatcagtgctgaaataaagttatatttccttttctgctctaaatatatagtgggggaataagagaaatgaagaggaattcctgagaacgtaattactagaaactcccctctcccacgtaatgtctctcacacaccatggacccctattcccccaatttgcgaccccccaccccaccccacaacaggtggtgatctttgtgaagtctgtgcagcggtgcattgccttggcccagctactagtggagcagaacttcccagccattgccatccaccgtgggatgccccaggaggagaggtgagctgaagatgggaaagatattttgtgtccttgggagaaaaagacagttgagagaagggaatctcaacatgttttaaatttcctttctcacaaaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtaaacctcacaggctgaaaaaatcccactctcccattcccttgttttctgtttgtacatcttcattcctgcctctgggtctctttcctcttcggtcttccagtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacagtgagtactgatctcatgaaaccctttaggtcctccctgttccttagtgtgtttgtcctaaatcccatcacataggtcatgggcatctgatgcataatggacacttgactggttcatgccccctggtctttgatgctgtgttgggatgtttttctgacctttatgtggggtttctgtcttctctcatcatattacatcccttccctcacccccacgtccgtcctctgaacccaggcagtacaccagtgtctgcatgtgtgccgtgtgttcctgcctcactttccccttttcatgccttattctgaccatgctacgttttcttctcagttgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcggtttgtggtctcttccactttctctggcctgggaagacgctggggtgtttatgatcccaaggctcctggtgggtggtgcgtgtattttcagtgccggagggtgctgtgggcactgggggaaacttaggcacctcctccaaggctctcttggtgcctcctcatctgttccttcagcttctggatcttgagcaccagggcttgggcctcccaggctccctcctgcccttcaaggagggcctggtacagctccagctgctgctccaacaactcttcagctcgggccagctcagctgtgcggtgggtcccagggccctggtcagggaattaagggagggagcatcagccagggcagggggccgaggccctgggaagctttgtcgcaggctgtggctggaagtgagaaattccaccttccctattcgtttttgaaccggtcatttaaggacacctgtactgagaaggccaggtagcttcctgtcttgggcataggcctctgggtggtagtagggggagcaaatagagttccctggcccaggggctgtaactggcttccttgaacaaggatatggggtcactggaaagaggatcagccgctcctccccgctaagaaataattaactgttaggtgagggggaatagatcctgttcaaggactttgtggactgtgctgttgtgggtgggggtggggtgagggaagggaaccctgaggtctgggctgggggaggtggggagaggagttggtagctgaactaagaaaagagctgcaggggtaggcatggtgtggggtggtgcagggtgggattgagggtttttttttcccacaccccagtgtaaattctcacaccctctgttcctacctgtggtgccacttaccctgggaggggacgtcatcttcccatttcctctggagttggtctgctcttccatgcttgctttggggttttgggagcagcacccatgggagccctggggtgccaaggaccaggagggcagaaggaggcgaaggaaatggtaccgagagagccagggcagagggaggaccatggcgggtgacctggccgggagctgtgtgagctgtccaacggccaccaggaactggttcgctccaggacttggcctcacttgagtgcctggccctgcccaggccccagcccccagccctgcccctgcccctgccccactctgccccacgtctctcccagcctggccccagacagagtccaggaacaactcctgttcctgatgtgaaaaatgtccctgccagtttaggcagaacttgctttagagcactggtgcccagcctaccacaggtctgtgattttttttttttgatctagtgtttattaggtatgaattttacaaacattagcggtagctgtggagctggagagtattgcaccttctccaagctgcatggcgagaaccaccaatagtgtggtagaacttacagccctttccaaggccgtggctctcttggcctgcagatagcctacgcatctccctatgcttgttgtggaccactgggtgtcaggtttccttctgatagtgttatggaatggatcaactaggatagcctcaaaaactttgtatgtggaatctttaaccagcccagtgagaattcaggactcagagccccacagtggcatccagcttgctcttctgtaacagactgaaggctttaagcaaactagctggttaacaccatgatagacaggcttgctgttaagttgccttcttaggaactagattttcagccaccgtggcgcttatatgtaacataaccttgcttggctgtagcccagtagcgtgctttattgggctgggtggggcggggatccctgtggagagcagagagctggtggtactgccagcagcggaccctcagaagaaagctcatgacatcagactgcttcttccatagcttctggatgtacttgtatgcaccatcttggtttacccagtggctgctgccagacagaaaggaaaggctaccacaggtcttgtgtctttttttttttttttttttgagacggagtctcgctctgttgcccaggctggagtgcagtggcgcaatctgggctcactgcaagctctgcctcccgggttcacgccattctcctgcctcaccctcccgagtagctgggactacaggtgctcgccactacgcccggctaattttttgtatttttagtggagacggggtttcaccgtattagccagggtggtctcgatctcctgacctcgtgatccgcccgtcttggcctcccaaagtgctgggattacaggcgtgagccaccgcacccggcatgcctttttcttaacactgttttctcacttcactctgcaaggtaggaattacctcactggtttgcacctgaggaaactggctcagatggtttcattcagcattcactggggaagtgtctgttgggggcagctctaggctggatgtgctcgaaggtccacagctggttgttggtagggcctggagggttcatgtctaggtccacctgacttgaaagctcatcctgaccttgcttaagtgctgattcccctttgcagatgtaccttttattgtgcttccctttattgctctttgcagatgctgttttttatttagagattggaggcttgtggcaaccctgtgtcaagcacatcaaacaggtctattggtgctattttcccaacagcaggcagacatcatgtctccatgtcacgctgtggaattctcaaaatgtttcaagcgttttcattattatacttgttacagtgacctgtaatcagttactgaagttaactattgtgattgttttgggacaccatgagcgatgctcatataagacagcaaacttaatggaaaaatgtgtgtgttgtgactgcttcaccaactggccattctcccgactctgctttccaggcctccctattccctgaggcacaacaatattgaaaggaataatccatgcggcaaatggcaaacatcattgtcttattttaagaagttgtcaaagcagccttcagcagccatgcccctgatccatggaggcaagaccctcccccagcaaaaagatcaggattagctgaagcctcatatgattgttagcatttgtttagcaattaagtattttaaaattaaagtatatggccagatacagtggctcacgcctgtaatcccagcactttgggaggccgaggtgggtggatcacttgaggtcaggagttcaagattagcctggccaacatggtgaaacctcatctctactaaaaatacaaaaattagctgggcatggtgatgggcacctgtagtcccagctacttgggaggctgagcaggagaatggcttgaactcaggaggcggaggttgcagtgagccaaaatcgtggcactgcactccagcctgggtgacagagcgagactccattaagtatatacacagttttttgtacacaatgctactgtacacttaacagactacaatatagtacaaacataacttttatgcacaataggaaactaaaaagtttgtgtgactcactttgttgctatggtctggaaacaaatcttcagtatctccgaggtatgcctgtcatttccctttccctcttcttgctggcccagaatgaccttgtttcttgcccctgtctagccctgcatgctgtaggggtttgccttctctggtaggtctgggcactttgtatcccttgtaaccttggctcctgggatatgacactggtacaactggcctcaagttctgttggactagtgagcctcccccaacacctcctgaagtagaaccaaaggcctgtgcacacaccgtgcatgtgtgagtctgcatagagatgtcagcttcctgcagggtgttctgaagggatgtcctgttgtgactggactgtgacatagccacaggcccagaggcaggagtggctcagaagggagtggctggtcccaattttgatcatctaggaacaggaaggtccttagaaaaccatgccccagaaggcaggattgctggagagtggacagctgctagccagctcgctatctggatatcactctgcattgggagggaagatggcctctgccatggtgtaagagtccaggaaccaggcagtgaggacttcccagcggtcagtgcttctcacacttgcgggccaaagcacctttagatgaggccaaagactttacgttcctcattagctgactttttcccacttaagtggaaaaagaacccagaacctttgtaaaagttttaggggagaagggctttccctcttgtatcttggtgataaggttatgcatgactcatactttaattgcaatgtgtacacagctaaagtcttaattattagaatataagagccccaaactactgttattatagataagcgaaactatgcagtatatggttaaacaatccacaactaattaacattgaaagttggccgggcgcagtggctcatgcttgtaatcccggcactttgggaggccgaggcagggggatcacttaaggtcaggagttcaagactagcctggcgaacatgatgaaaccccgtctctactaaaaatacaaaaaattagctaagcgtggtggtagccacctgtaatcccagctacttgtgaggctgaggcaggagaattgcttgaacctgggaggcggaggttgcagtgagctgagattgtgccactgcactccagcctgggcgacagagcaagactccgtctctcaaaaaaaaaaaaaaaaaaaaaaaagaaaagaaaaaaaattaactacatttttgggaggtggacagagcaatgctctgtcacccaggctggagtgcaatggcacaatctctgcttgctggaacctccgattgccgggttcaagcaattcttatgcctctgcctcccaagaagctgggattacagacgtgtgccactatgccgagctaatttttgtatttttagtacagacagggtttcaccatgttggccaggctggtcttgaacacctggcctcaagtgatccgactgcctcagcctcccagagtgctgggattacaggtgtgaaccaccgtgcctggccctctatctgttaatttaaaagattagcagccatttagaaaaaacaacaaatgagacttttgcaagacaatctaaatgatacactaataacaatcctttgggaaagtgacatttcaaccatgtgagtttctgctttaggttatgaactccaaaatggactaaatggactaacccccaataatttatagtagctagtttttttttttttcacagtaggtaattctaaaccataaataaaatagaatctgaattttggctttgttcacctgtgggaacttaattaagaaagcactggcctttgggtcggttcaaatatagtggatgaggccaggcgcagtggctcacacctgtaatctcagcactttgggaggccgaggcgggcggatcatgaggtcaagagatcgagaccatcctggccaacatggtgaaaccccgtctctactaaaaatacaaaaattagccaggcatggtggtgcacgcctgtagtcccagccactcgggaggctgaggcgggagaatcacttgaacccgggagccagaggttacagtgagctgagatcatgccactgcactccagcctggcgacagagcgagactcttgtctcaaaaaacaaaaaacaaaaccaaaaagaaagaaaaccaaatatagtggataatcgtggatctcataattgtagaaatgaaggaattaagctaaaaaaatacataaaccagaatacctagtgctaaagttgaatgtccccaccaaaactcgtgttgacatttaattgctatcctaatggtattaagatgcaagacttttttttttctttttttgagatggagtttcgctcttgttgcccaggctggagtgcaatggcacaatctcagctcactgcaacctccgcctcccatgttcaagtgattctcctgtctcagcctcctgagtagctggaattacaggcacatgccaccacgcccagctaatttttgtatttttagtagagacggggtttcatcatattggtcaggctggtcttgaactcctgacctcaggcgatccacctgccttggcctcccaaagtgctgggattacaggcatgagccaccgtgcccagccgatgtgggacctttcagggttgattagattgaatagattaatgccattgtatggcatgatagaaatcagttcagcctctttgcccttccacctctcactatgggatgatactgcagccaggccctcataagatgccagtgtcatgctcttggacttctcagcctccagctctgtgggaaaaacatttattttctttataaattacccagtctgtgctgggtgtggtggctcaagcctgtaatcccagcactttgggaggccaaggtgggtggaaggcttgagcccaggagtttgagaccagcctgggcaacatggcaaaacccatctctacaaaaaaacacaaaaattagctggtgtggtcgtgcgggtctgtggtcccagttatttaggaggctgaggtgggaggatcacttgagtctgggaggtggaggttgcagtgagtcgagatcatgccactgcactccagtctgagcgacagagagagaccctgtctgaaaaaacaacaaaataaattacccagtctgtattattctgttatagcggcaggaaacggactaagacacatagattatgttactgtgtttatttatttattgttgtttttgttattcctgactcttaatatagagtcttaatcagatgagcattctggcctggcctccgcagaaggggcctgtctttagccacggacaagaggagattaaggccagcatcatccacaaggtcaaggggctgcagagccccctaaggccagtgtgctgatgggcccctcaatattgtatcctacccagtggattggcaggactgggtgactgacaggaatcattgttgcctctatgggaaagtcttatggagatgggggctgagggatgttgaagtttagccattacattacagtgagagagattacattactaagtgtcagagacccttctgggcactttctgttactgtcacaggtggctttcacagtaaccttttaagagagctcttttcatttttcttgtacatggctgtccagttgttccagcagcatttgctgaaaagactatctttattgtattgtctttgctccttgtatttatgtgggactatttcttggctctctattctgctcaaccccatctctattaaaaatacaaaagttagtcgggcatggtggcaggctcctgtagtcccggctactcaggaggctgaggaaggagaatcacttgaacccaggaggcggaggtggcagtgagtcaagatactgccactgcactccagcctggggaacagagggagactccgtctcaaaaataaataaacaaataaaaatttaaaaattaataaataaaaataaaaaaattagctgggcatggtggtgtgtgcctgtaatctcagctacttgggaggctgaagcaggagaatcgcttgaacccaggaagcagaagttatagtgagccgagatcatgccactgcactccagcctgggcgacaaagcaagactccgtctcaaaaggaaaagaaaaaggaagctggaagctgaatgagatgggcctttcaaccaaggagttagaaggccatctggtggcagggctggcagaggaccaggagtaaataaggccagagaggacaccagggtctgggagtgaaggcactgagcttgggtccccctttggaagacaatgacctgagagctgtgagatttcagacaagttcccgaaccttttgggccctgctttcctcatctgtaaatgggataatatcagtctcaccagcttcttaaaattcaatacaatggagttgggtgtggtggctcacgcctctagtcccggcactttgggaagccgaggtgggcagactgtttgaactcaggagatgcagaacagcctggataacatagcaaaacagtctctaccaaaaatacaaacaattagctgggcatggtggtgtgtgcttgtagtcccagctactagggaggctgaggtgggaggactgcttgagcccacgaggtagaggctgcagtgagccatgattgcaccactgcactccaggctgggagacagaatgagaccctgtctcaaaacaaacaagcaaacaaacaataaaggaaatccctaccacactatcaggggcattttggctgagcgcggtggctcacgcctgtaatcccagcactttgggaggctaggctggcaggtcacctgaggtcgggagtttgagaccagcctgaccaacacggagaaaccgtctctaccaaaaatacaaaattagccgggcgtgatggtgcatgcctgtaatcccagctacttgggaggctgaggcaggagaatctcttgaacccaggaggcagaggttgaggtgggctgaaatcgcgccattgcactctagcctgggcaacaacagggaaactccatctcaaaaaaacaaaacaaaacaaaaaacaaaactcccatttttgcgaggcaaattgggctcacagaggtaagctgcatgtccctgttgatggcagagctggggtctggatgcaggtctgcttcggggtaatccgctcttttgccttccagggtcctgcctcttacaatatgagctgtcaagttagatgcctgcactcagtaaacctactctgttttaagtaaaaacaacaagaaacaaatctgaatatgctagcctatctcaggtacgttaaaggaaatttttaaatagggggttttttgaccatttgggggagttttgggggaggggccttctgtctatacttgagctgggggatgttagggttgttcatctggatctagaggttttcctgtaatgttcttactccagaaggaaatctctagatggggaaagaaggtttcagcttttattctagtaagcagggctctacctataaagagctgcttccaccactcttttttttttttttgagacggagtcttgctgtgttgcccaggttggaatgcagtagtgcaatctcggctcaccacaacctctgtcttccgggttcaagtgattctcctgcctcagcctcccaagtagctgagactacaggtgtgtgccaccatgcctggctaatttttgtatttttagtacagatgggggtttcactatgttggtcaggctggtctcgaactcctgacctcgtgatctgactgccttggcctcccaaagtgctgggattacaggcatgacccaccgcacctggcctccaccactattataatatcaccaggttccccatttgaatccttcagtgccaaaggttttgcagaattcaaatgtttttgggacttgatagggctgacctaaaagtacactcactctatattaggtagcccaggagggcctaggcagcccaagaaccaaacacatgagtgtttctgcagggaaatgtatgaatattgacatcagtaggatgaaaataaataatagtcttactttagttcagattaggtttctgtcaccaaatgaattttggtggcagcctgatgaaaaatgttggttctcagagtgtttttgagtttagaattgtggttaagggagtatggacctgttgataacaaaaacaggaacaaggccaggtgtggtggctcacacctgtaatcccagcactttgagaggctgaggttggtggatcacctgaggtcaggcattcgagatcagcttgtccaacatggcgaaaacccatctcttctaaaaatataaaaattagctgggcgtggtggcatgcgcctgtaatcctagctacttgggaggctgacgcatgagaatcacttgaacctgggaggtagaggttgcagtgagccaggatcgcaccattgcattccagcctgggcaagaagagtgaaacttcataaaaaacaaaaacaaaaacaaaaaacagagaaacaggaacaacaatcgccagcatataccaagtgcttatcgtgtgtgccaggtactctaattatgtactatgtcagttgattctcaaaacatatatggcacaacatgggtactctgaacatgggcacaatcaatgtacaatgctataatgtataacacaggacaatgtagctgttaaaagcatggacactctatctagtccatctgggttataatctctgctctaccagtgaataactgtaactctggcaaatgacttctctatgccctgtttcctcagctgggaaatgggggataatatcagtactcacctcctaagattgttgtgaggattaaatgtgttactttataagaaatgtctggcacatagcaaaggttgttattattttaatttttacacatgggcaaactaagcctcaagtaacctgtccaagaatacgtagctatgaagtgtggagctgggatttggagctggggtttgaatccaggcaatctaactccagagcctaccttctatgctactttttggctacgagcaaacaatctgtcaagaaacaaagtagctactaatctaaacagatgtgaaatttgaagaccagttgatctttggggaatgttgggttcttcagacaatggtagctcagtaatgtaaagggacaaatgacagccacatgccaacttggttaactccttccctaggtcctgatgaccaaataaccagcttatttctcaactattggttggctttcatttcaggtctggtcagctgcttatgaccttgttccccactgagcagactcaccatctgggccctggcgggcagcagcatgcagtgccgtgtccccatggcggtcctggtgggcagggtcagccccgagccgaagcagcaggcacagggcaggggcatcgtggcgggcacaggcccggtgcagtggtgggggctgcccagcatctacatcgaggcctgggtgtcgctggaggagggcctgggcccggaccagccgtcctgcagacaagtaacgacgaaagcgacgttctcggcgttggcggcgggaagtggaggccatggaactcttgggctggggaaggaaaaaaggcagcagtcaggacttcagccttggctggtccttctccctccatctctgacatcccctgttgtttctccctttggttccgtctttttttaatatcttcagcaagagatgaggcctaacctaaccctgatcctttatcagatgatagatttgaaaaaaaattttttttgaggggggtgataggatcagaggtttaatttttttaatgtaaaattcgagaaaagggtaaataattggtttaaggctcaggagcccaggtaaatttttaatttttaacaaagaactttaaaaaaacccaacagggccggatggggaaaatttttatcagcagaaatctgagttttaaaaagtcacagataatctccaataatgatctagaaattgaatatcatgtacccggcagacagatgtggaggcttcttcctctggaacctggggggaggggttactcatcagacctgcccccgcccccccaagtacccccagagccgtaggcccaaggcctgtgtttaagaagctcggagacgggaggcgggaagggcggagacactccaggctggaggaaatggcgcaagcagagacgcaggtggaggacggaagtgaactgtgaggggcgttaccggatgtcgttccgccccgaccgggtagttcttggccagatctcccaggggaaactagggaacttaaattaaaggggccgtctgaaaccagaagactggactggaggcgaggaaaaggaggcgaggggaggggagggagaaaagagagttatttggaggttttttcccgcctcctctaacttggcagagagaggagatggttcagtgatggacgaaaagatgagaagacagagaaaatagaggagataaagacaggataaaaatcacattaaacatggaaaacaaaaacaaaaaccacagtgggacaacaacagggacagatcaaaaaaaagaaaaaatacagacaaaagacggaagaagactatcgtaggatggggcaagtgagatgcaaaaatttggacttgagaaatatgtagaaaaagatggagatgttaacaacgggaggcaggggagggggcgggatggtggagagagagagaaaggtagagagttagtttagaattaagcccagaatgctcttttcccaacacaggttgcatgatgacatccttaccttttcaccgcattcacaaccctttatgcttcctctgttaccaccaatcaagttctccttctctcacctcagtactcccccgtctccgcccctgcctcatccctagacctttccgactgggatggctaacctgttgtaagcccgcagctttgggcctggtctctgctgctcccaggcggcccctttgggtactgcctgagcaagaagtgctggagaggaggaccagtcatcaataggaggatgagattgggagagacactcggtgcaggaggctgagtgagcaggggagcactaagacccaggggtagtggaggactgcagcaacgagctggaggaggagaagtaagcggtggggggtgggagccatctggtactttgacagcattcaaaacagcatcggccataacaacagaaatggccagtcagtcccaaggtatccagcagcttctgcaagctgagaagcgggcagctgagaaggtggcagatgccagaaagagtgagtctcctctttcctcccttaggagtttggaaagaaaattgggggtgggggacagcaaacattttgggaaaacccaaggctggcgggaagacagctagggtctggaggctggttaggagggaagaaatggatggatattagaatctggcacctggttggctgagagaaggctgtataactttctggaagggactgactcctgctattacattgtgtgtgtgtgggtccatccccactcactgtcctttcttctgcctccagggaaggcccggcgactgaagcaggcaaaggaggaggcacagatggaggtggagcaataccgcagagagcgagagcacgaattccagagcaagcagcaggcggtgagttgaggcagagtcgggatgagaccccactgcaagttggtgggtgcatctagtgaggtgtgtaagggtgactcaacaagaaaatatggtggcagagggctgaggctgaggggaccctggcagggaccacaacattggtgaaactttgtgatgatatgtaggagagtctgggagttttgaaggccacatagagcttgtgggcggaatgccacagtctgtgtaaagtataacatctatgtggagtatgattaacatttgtggtggagggtagagttttatggtcatggatggtgaggtggtggggatattacggtctgttttaggatgaagttgcatgttaggtctaaggggaaaggggactgtgttgatctctttggtgttgggatatttctgtgggatgggggtggtttctgagagggcctttcttctaggctttgtttcaggatctttcccctcatatgcctggacccttgtctgtttctgcttttccctttctctcttccacccctctccctaccccccaggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaattggtgagttgaagcagcctccttttgcctcatcatttctcattttcagtcactttgttttttttttttttgagatggagttttgctcttgttgcccaggctggaatacaatggcgtgatctcagctcattgcaacctctgcctcccaggttcaagcgattctcctgcctcagcctcccaagttgctggaattatgggtgtgtgccaccacgcctggctattttttgtatttttagtagagatggggtttcgccatgttggtcaggctggtctcaaactcctgacctcaagtgatccacctgccttggcctcccaaagtgctgagattagaggtgtgagccactgtgcctggccttcagtcactttcttgttttttgtttacatattccctaaacagcccaaatggctatcctttgaaacttcttggagaaacaagaacaagtagtactttattatttctctaaagtgagaaacatggttcctcatttgggaatctgaggactatagatcgcaactgtagagaaaagctggagtgtaggagcaagtgctctttgcccctttaccttgcattttcttcatagcacttactgctactggttttttgagacaaggtcctgctgtgttgcccaggctggagttccagctcacggcagccttgaccccctggactcaaatgatcctcccacttcagcctcctgagtagctgggattacgggcgagtgccactatgccttgctaattttaaaattttttgtagagatggggtctcacttgcccaggctggtctgaaactcctgggctcaagcaatccttcgggctcggcttcctcaagggttgggttacaggcctgagccactgcaccctgaccacttatcgatacttgacattatatttgtgtttatgtgttttctttcctgtaatgtaaacactgtgagaacagggctgttcaccgttgtgtccccagatcctaggacaacatgtggcacaagggaggcagttgataaatacttttgaataaattaaatgatacttgggaaaataccttctatgacaccattcttgaattagttacttcatttgtcactgaagacaagcttacttcaccaagaatttgaaccaataaggtaacctgcagtgtatttactaaccagattctttgagcagggaggcagaatacaatagagaatgagagatgtttgcatcctggctgtaacctcaccagccgtactgcttgagatatgttgctttgcttcgcttctgtcaataagatgagaataacggtacctactccttagtattaaatgattaagtatgttaacagggagagggccaaacgtttgttgttttattacacagcaggacatcaggtcttacttttgtggctccccatctcaaagacggggatagcaaatgtttcattcaggaaaaaaatccaggttgaacaatggggctgttggggcggggccaagaacattctgctcgaattaacagtattaatgggccgggcgcggtggctcacgcctgtaatcccagcactctgggaggccgaagtgggtggatcacctgaggtcatacatgggtgaagccccgtctctactaaaaaaacaaaaatttgctgggcgtggtggcgggcgcctgtaatcctagctactcgggaggctgaggcaggagaatcgcttgaacccgggaagcagcggttgcagtgagccgagatcaggacattgcactcccgcctgggcgacagggcgagactctgtctcaaaacaaaaacaaaaacagtattaatggaatgtagtataaccctcaagccctactattaacacttggggccgaatccagaccccgtcttcccgctcggattcagaacaccttcctgactcactggccctagggcatcagctacctcggacagcatccttttgggaaaataccgcccaccagccccacgactgggaaagagtcgggaaacacccccgagcaatccagttccctgagacttccctcctccctcccctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttaggtaagctttggccttcgctacaatccgtttccatctgcgcttctccgcacccatcccgtcacatgggttcctgatacccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttggtatttgcggagggcggggctcttctcaccttccttgttctttcttgagctctttttcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggaaaagaggtcgtgattaagtcttgctttttttttcccccctccagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggtaaattttctcttgggcatgtagtgctcattgggctctttaagggtacaatacaaagatgtgtttgtcgttgctcaggtggtggtaagggtttatacttaaggctagatcagggccaggtgcagtggctcacgcctgtaatcccagcactttgggaggccgaggcaggagggtggccacttgagctcaaaagtgcaagagaagcctgggcaacatagcgagactcctgtctctacaaaacgttcagaaattaagcaggtgaaggttgaggcttcagtgagccgtgattgcaccactgtgcaccagccggggcgacagtgaggaagaaaaaatcaggggataagtatcaaaaacaattttggatagaggaggcttatacaggcttattctttctttcgtgatagcaccaaagtgctaatgatccaaaagtgacttccaggtctgccattcattcttgtgactggcttttcttgtctgcttatttttaattttgtcacttgacttctaattttaaatttccagaaaggtcctgcttggacctgtagtctccctctgttgggccaggccaactgtggtctctggaaacctctatgactggtttagagatgactggcttctgggtcaggtaccaagtccttcattttgtccagggttgtagtagttacgtgacccgaagtatagcaacctaagcaggagaagtggtctgtggcaggtattcaaatgtcatgaattgttacagattaagaaaaataaggacagagctaggatcattgaaggtgagcggttggtagatgcaaggggtttgttactaggactgggaaggcctagatctggaggaggctaaagctaggaggaattaggagagtctgattttgaggtgaatgtaattgagcagagagaggtaaaatgggtctggaagttggcaagaaccaggtaaatactagactttgagaattgagtggtaagaaatgggcttggcatggtgaaaaaggtagagttatctggagactgaagtctaatttatcttcctccccccccaacttttagtccagcatgagtgcatccctcaggccattctgggaatggatgtcctgtgccaggccaagtcgggcatgggaaagacagcagtgtttgtcttggccacactgcaacagctggagccagttactgggcaggtatatttggggagagtgctggggaggggattttggttaggactataagggaagggtgtttttgtcctaactacatgatgcttgcagagccatgagcacatgacctctgttacccttgacaacctgacagctgtgggggatgttctgtcgcaagcgtggggttcatgatttagatcacagaattgaagtcatttattatcggcccaggtgtgtttttgtgacagtcacttccctagaggggataatgaagagctacatttaccatatgtctccgtctacttcctgcctaaggtgtctgtgctggtgatgtgtcacactcgggagttggcttttcagatcagcaaggaatatgagcgcttctctaaatacatgcccaatgtcaaggtaagccaaggtaaagagacctgagagtgagggtgtggcaagttggagggataagaaacttgtaggccaatagtctctttaattttggagaagctttagtttgctgtggtgtaacagagtgttgagttcctatgtaacaggaggattcgtaattgggctatggatgatgcttaacacaagaccacccttttcttactactttatactgactttgaatcatatcagtttaataattttggggtatgtggcagagaaagccggaaactttaaaacagctccagtggtgtgtgaatattgaggattctggccaagtgcacaatggcttacacctgtaatctcagcagtttgggaggccaaggcgtgtggattatttgaggtcaggagtttaagaccaatgtggccaacaggatgaaaccctctctctactaaaaatgcaaaaattagccgtgcatggtggcacacacctatagtcccacctgcttgggaggctgaggcaggggaatcgcttgaacccaggaagcagaggttgtagtgagctgggattgtgccattacactccagcctgggtggcagagtgagactcccatctcaaaaaaaaagaaaaaatctgattgaagttaagcatttttggcaagaatccttcataggtgatgctgtatctcctgttatgccacaaatctggtcgacttatgttagttattttattttatttttatttatttgttttgagatggagtctcgctgtgtccttcaggctgtgagtgtagtggcgcgatctcagctcactgcaacctgcgcctcccacgttcaagcgattctcccgcctcaaccccccgagtagctgggactacagtgtgccatcatgcctggctaatttttgtttttttttagtagtgacagggtttcgccatgttggccaggctggtctcgaactcctgacctcaagtgatccacccacctcggcctcccaaagtgctgggattacaggagtgagccactgcacctggcctcattaatgattttagatttaccataggattagcgtcgtgacagtctgattccacagttcttttcccccttgaaaccagaaagtagtttctggtgttatttgatactgtaccaaggcccagatccccaaacaactattcacctaatggttttaacatgaaatgataatatttagcccgaagcagtaatttcatggggtttgtgtgaaaagagtttgagattctgggtttatttaggaaaccttaatgttccatgtgttttttgtggtactttacactaatctggtgatttcttgctgtcctttatttatttattttttattttttgagatggagtctcgctctgtcatccaggctggagtacagtggctcaatctcgcctcactgcaatctccacctcccgggttcaagcgattctcctgcctcagcctcctggctaaattttgtattttttgttttttagtagtaaatttgtaaattttgtattttagtagagatggggtttcaccgtgttggccaggctggtcttgaactcctggcttcaagtgatccactttccttgacctcccaaactgctgggattacaggcgtgagccactgggcctggctttattttatttttatttattttatttctttttgagatggagtatcactcttgttgcccaggctggagtacaacggtgggatcttggctcaccacaacctctgcctcccaggttctcgtgcctcagcctcctgagtagctggaattataggcgtgtgccaccacacctggctcctttattttttaaatgaagcctggcctcataaatgaaggaagttggttagattaagtcagtagaactgaattattgtcctgactgctccgactagccatgtaactttaggcaatcaccctcagtgtttggtgggggggacataaaatttttaaattaggtgacctctaaagttagttttagtttggaaacatgctaaaaattggtttagctcaaacagagtgggaaccctggggggattggactctttccttcctctgttttgagactctttgcttctggctcggcaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcggtgagtggcagtgctggggcttggctaatgctggggagttgttctttggagccaaatgatgtttatttgaaacaggagcacctcagtgcaaggacgactcttatctatcacccatgactgatggctctgggttccctggttggtctttattatgcttttaagcacagtaaagggtgtcatctatcatctttctatgatttttgtttttaacctttgagaataggggactttgataattttaggcataagtcatcaccaccaccaccgttttcattatagattcatatactgggagtcataggggagattctaaactgaaagagaagacagtacccttctggcatctccagcacagcatttacagtcagaatttatagctgaataagtgtctagactcaggtctgggattaatgtagagagtgtttgtagcagtttgtgtgatgtggtattctagtgtgccaggtggggttaatggaagatttttctgtaagaattgaatcttggtgaatgagagtggggttggacataggccccataagtcattacaaatgatctttggcaattctatatggtaagctataaaggtgggctccaggtagggatgtcatatttgcctgacttgatagaaaagtaatccagagagtcatagatggactctgatatctggaatataatatgtgcttgatatttgtagtctgctgaaggctggctggggcttgggcaggaaagggttgggagaaggtcccataaagcatgttttgaaggccttgagagcctctgcactgggctttatccccatttcatagttgggaactttggggttttaccttatttcttgcttggttaaaacaaacagctggaatctgatcccacttcttgattccaagtccattgctctttccattgtgttgttactatttccagcaatcttcacctcactgggaagtctacctctaatctttgtttatcatacctgcttattttctcctacaatttttttccttgttcttgtagacatgcgtcgggatgtccaggaaatttttcgcatgaccccccacgagaagcaggtcatgatgttcagtgctaccttgagcaaagagatccgtccagtctgccgcaagttcatgcaagatgtaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagggcctgcgcgggtgccagggaaactccggaagacttggtcgggttaatgtgagagcgggtagtgttcgactttttcataaatcacaacatttttgaacctcttctcccttcgggggagggcaggatttttctgccctaccacccacccatccatcgtctcttacatgcaccctacagccacgcaccctcaaggtggcatcgagcatacagctggagccttctgctcaccaaaactcctacttcccggtggcaggagagcaagagagggacagacagatggcagggcatgtccaaaagaagagcatcagcacaaatgaatcctccccttccccacctccaggggtgggggcctttggcacctcaatccccgataccctactccttcccacccacatctccttgcacccatctggaacctcggttgatgtgagccggcaacagagaagcaccgtggcgcggcgagggaatgcagacggcacccagcggtggatggcggcagcggaggccgcggggaaacctgaccaggaagctgaggaccaaaccagcctctttttccgttcccggtttttttcctgaacccaacgcgtgccgtgccccgtttcccccaatatgtgttggggaggggtgtcctgaatggggtggtagattttttttcttaaaaaaatttttttgttttttttaatactcagaggagagggacataggaaaggtaaagtggatgtaatcgggtggttgttagggtttggggctaggtggggccaattgcataagcagtggagtgtgttcttcccctccctgcagtgttccttcccgtgggatgatcactctttagctgtatttggggctagaatgagatttgaaggaggccatggaacttctctttagaaagcctgccttggctgggcctggtggctcacctctaatcccagcactttgggaggccaaggtgggaggattgcttgagcccaggaatttgagactagctggggcagtgtagtgagactttgtctctaccagaaaaaccgggcgtggtggcgcatgcctgtagtcccagctacttgggaagctgaggcaggagggtttgcttgagcccgggacgtggaggtggcagtaagctgtaattgtgccactgtactccagcctgggtgatagagtgagaccctgtatcaaaacaaaacaaaaaacaaaacctgccttctgggattgggcttctggtttttttcccatgacacacacatcctttcctattttgtcctctgggtcttcatattaactatcttcccccaggatagtataaaaagtgttaggaaagttgggctttggagttgtggtaatttctgtctttgttactttcctccccttcagggggttttttaattttaaagatgaatgcagtgaggtataatggtgtgtgcctgtagtctcagctattcaggagactgaagcaggaggatcacttgagcccaggaatttgaggctatagtgtgctatgattgtgccagtgaatagccactgcactccagcctgggcaacatggtgagatcctgtcccttaaaagcgtatctgctgctctgaatttggtattttaacaccacttactgatacctttcctgtaaacctgtagatggtttaattcttagtcaagagaccagtctcatctaaaactatcctgttgtggtctgacggcaagtaactcatcttgagtaatttttgtttctccttaagtggcattttgactgtccattgcagcattctgatcttaaaagacatccactttgctaatgcacacgagattctcttagttgaagtaggagaatcaaatggagcagttgtcctccccccaccccatgttcttagaagcacctctgatggagttattctgaccttgagtcactgcctcccatcatttcccagatgtttggtccttgctctccctttgagaatcatctcccattttctttcctctcccacctctatttgaggtaatggcatctgtgccattgggtggtttcactgctccttgacttcatttgcagtttctttcccatgatagtttttagttgggcagtcttaaaactcatctgataggaaggaaattagatgtaatgtgagagagaccacagtaaaatgtgggtatttttgggagtggggtggggttttcaatcttctctttcctccccatccccccatggggtgtattggagatcaacttcctccacccccccaggtttaacccccccactctgccctcctcccgttccccacccccttcctc

SEQ ID NO: 1563 - DNA, 1658 bp, Homo sapiens
ctaaaggctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtggggtgaaggagacactactgcccccacccctgacagcccccaccccatggcttccatcttttgcatcaccaccactcctgaacccccatttctgatttgtcagaattttttttttaacaaaactaaaaatgaaaaaaaaaaaaaaa

SEQ ID NO: 1564 - DNA, 1287 bp, Homo sapiens
atggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtag

SEQ ID NO: 1565 - DNA, 26320 bp, Mus musculus
tcatggatggctgtgagccaccatgtgggtgctaggaaccaaacctggagcctctgcaaaggcgacttgtgcttttaaccactcagccgtctccgggccctgagccgagacagcctggtagaaagcctcagcccagcatggagctgcctcccaaattctggcattcaaggtgtgcaccaccactgccggcttgtctgctttcaaagagctttaagtgggcacgcacatgtgtggtggtcccaggacaacactgtagagttggctttccctttcacctttatgtcgatttcaggattaaactcagattgtctggctcgaggagggggtcttacccactaccctactccagtagacctgttgttttgttttgttttgttttgtttttttctggcaaagggtctgtgctggttaatttattgtcaacttgacacacaaactggagacacctgggaagagggaacctcaattgaggaacagcctccatcagattgacctattggcaggtccgggggatattttcttgattaatgattaatgtgggagggctcaactactgtgggtagtgacacccctgggcaggtggtcatggactgtataaaaaataacaaattaaaaaacaaaccaaaaacagcaataacaagcaagctgagcaagctatggagagcgatcactttaaagcaacattccctttctgctttacaaaccagttctgcccacaggctcctgctgtgcggtccagcttggcttctcttgatgatgagatgatgaattccaatcataagatgaaatgaaccctttccttttcaaggtggttttggtcaatatgttttcctttttctgtttttgttgttacttttctttttccaagatttaaaaaaaatttttttaaatagtgtgtgtatgtgtggtgtgtgcctgagaggcccatgacatgcatttgtgaatgtcagtgcagttgcccatggaggttagaggagcaggacctccctagagctggggttaggggcagttgtgagttggcctatgtgagagctgggaatggaacttgggtcctctgcaggagcagcctgcggagttgtttctccctctgcttggtcagtgtttttcacagcaacatgaaagactaggagaggatcttatgtaacacaggctggttttgaacttgctatgtagttgaggctagccttgaacttctgattctccgacctccacctctcagtcactgggattctgtgtgtgtgctgccatgcccatcagtacctagtttagccaatatcagtccccaagaacaagaagtatcaaaggagaaaagcactctagcgcctctcatccagagcatcccccatcatccagcagcccaaggtacataacaaagagaggagatgacactctcccaggggcacggcatgcttccagagtccactttgactttaggaaacattcacagtgtttcctaaatgacttctgctcctggagaagactggagtgaggacagccaggcagtcagaagggccacattcacatggtcacacccacatgtaccctcctgatttcctggctttgttaacttcccttccataactctctgtctctctctgtttctgtctctctctctctcagtctcttgtcttcccccagcagttctcaacctgtgggtctcaacctctttcagggttgaatatcaaatatctggcatttcagatatttacatcacaactcataacagtagcaaaattacagttatgaagtagcaataaaaataattttatggttgggggtcaccacagcatgtggattaaagggttgcagctttaggaaggttgagaaccactgcctgaaaaccttaatcaagcaacatttctagaaaacctctttatatgacctagtaaaaagtttttactgaggtgtggtagtatatacacctgtaatcccagtactcaggaagtagaggcaggaggattgtcacagtttgagaccaatttggtcgacaaagagagtcctaggccagccaaggctacatagttaaaccctgttacaaacaaataaacctgaaaaacaaaatgaagcagagatgtgaaaggactgagcgaggaaaggtgcttgttaccaagtctaggatgtggtagaaggaaagaagtgattgatccctgaaagttgtcctctgacctcctcatgtatgtataagtacacacacacacacacacacacaaacacacacacaccaccaccaccacccccaccacccaaccccacactatacagcaaatagtaacagcaaagttcctggcatggtggcacacacctttaatcccagcactcaggaggtagaagcaggcagagctctctgagtttgagggaagcctggtctacaaagcgagttccaggacagccaggactggtccacagtcctgtctcaaaaactctgtctcaaaaaaccaaactaaccaaccaaccaaccaaccaaccaaaccaaaccaaaaacaaataaacaaacaaaaagaccaaaaccaaaaccagtaaagcaaagcaaagcaaaacaaaacaaaacaaaacagcaaaagagtaccatcactaaaactgcaacacaacacaacacagcacaacaacagctttagtcccagatctccgtcacaaaactggaaagttccttgagagtactttgaccatctgtggccactacatcttctgtctgtttgagacaggggctcactatcggaccctggtggtctggaactcactatatagacaactgcctcaaatttgtgacaatcctgggaataaggcctgcaccaccacacctggcttgtgaccatcatattctttgctgaggcttcacagatctgtcaacaagacttgtaaggtggctgctgcctggaaagacacagtgtatccgtggagaacagagctcattcttggagggtttgggccaagtgcagtttaaattctggcagtgttcatatttaatcttcagaaaaggagttaatctgtcagatctcggttccttgaattgcagaattctacacacactcacacacacatgtgagagcacatagacatacagacacacaccacatacacagagatatacactaaataaaaatttctttttaaaaaatgagatggtacatatcaaatactcataagaggacctaaatggctgggcatatagtgcatgtttgatgtgtatgagaccctggatttggtggccagaactaccagaacaatgtcgtgttacagaaaaaacaaactgcatcagaaggccagtgctacgagttagctattgatacttataattcattgacatccctggagacctgctggggcaatcttgtctcagaacctgctccgcactgaactgtgctatctctggctctaattacttcccttctcccacactttagagagccggtagaacagaagtctataacaaggcaggtgcattgactcgttttatgtgagtctacctgcacggttcgagggtggggagcctgaaaacaccacagctgctcagtctgcacagctggatgcctcagtagtcctaagtggtgctgacttcctgggtgactcctggacagccctggtcttcagtctgcattgggaggctgaggcagctgcatgctaatggcagggacagtggctttgaccagacaaaggagatcaaacaattgacaccttttgtggaacttccctggaggtggaccatcctgggaggtcctgcccaccctgggtgggctttcttcctcagttgtccttcatggaaatatcctatagaccttctcaaagaattttttagttgagtccggagccaatcaaattggcagttaagattaaccatcacagagcacctttgatcccagcactctagaggcagaggcaggtggacctctgagtttgaggccagcctagtctagagagagagagagagagttctagggcttcagaaagaaaggctgtttcaaaactactccttcccccaatattaaccaacacaatttgtctctccctctttctgatgtttttagttgagatgtcaacaaagaccaatggcggagctcgaaggaagccttggtggtggtgtcctgtcacttggtaggtgcagctctcttccttccacctctagaattatgttatccagggtgttcagtgaacaggacaaagaaatgaactctacttgtgtaaccagattattatgggctacctctaatctgtcagaaagaagcaaggggctcagctagctcatagtttttatttatacaagcttttctcattagtttatttgacagtgctatttaggagccacctcagactcctcttcaaatatccaaaatgtccctggaaacttatattagttttctatcaaaatccaagtacgtggctgcttcctctcttcctccttctcctcctcctcttcttcctcctctttctctaccaccatcttcttcttcccattcccattcccattcccattcccattcccattcccactcctattcctattcttctttggagacagagtcttgctatgtcgcccagattggtctcaaactcacagcaatcctcctgcctttatctcctgagcactaggattataggcatgaaccaccatgcccagtttatcaagttcctggggactaaacacggggttctagcatgctctctatcaactgagccacattccatctctgatgtcacccatctttaagcaatgataggtttcttctctgtgcgcttttttcatgtggtgcttagctatttggcttccgtctgttcgctttgtgctgattctccacctcccttgctctcagaagcacatacatgtgagcagctttccatttaattttggggatgtatgatttctgaaatgttattgggaacccagtaaggaagtgactgaaggaaggcagcaacatcccatttggggctgggacgttaagtgggaataccccaggcagatgagaagctaaggttattccaggctatcttagtcagggtttctattcctgcacaaacatcatgaccaagaaacaagttggggaggaaagggtttattcggcttacactttccacattgctgttcatcaccaaggaagtcaggattggaactcaagcaggtcagaaagcaggagctgatgcagaggccatggaggaatgttcattactggcttgcttcccctggcttgctcagcctgctctcttatagaaccaagactaccagcccagagatggtcccacccacaaggcctttcccccttgatcactaattgagaaaatgccttacagttagatctcatggaggcatttcctcaactgaagctcctttctctgtgataactccagctgtgtcaagttgacacaaaactagccagtacacaggccaagggaaacctctgtcatgggtgcttatctctagccattgtgttaatattgcccattcccatcagcttatagatctcttgaggtcatgaacccatgtgagttcctaaaatgaccagatagctcattattttgccatttgatgcctacttatggattgatttggtatgtaatgaactttctttgtgtttgtgttcactgtgatattgtatttctagtatttcactgtaaagaacatagagacgtaaacaaacaaggtccacaagtccagtaacctcactacctagagagactactgttaatatattgtcctgggtgcttctcttttcttttttgagacaggatcacatcatgtagctctggtttgtctagaactctctatgtacaccaggctaccctggacctcatagctatctgcctgtctctgcctctaggcatgaaagacaagcacaccatcatccccaaatctctcccttctgaccaagagaggttcttgaacctattattcttctgtcttagcctcctgagatcagggctatacagatgcatgtcactattcctgactgttttctttctttctttctttctttctttctttctttctttctttctttctttctttctttctttcttccttcctttctttctttctttctttctttctttctttctttctttctttctttctttctctttctctctctctctttctctccccctctctctctctttctttctctctctttctctccccccctctctctttcttcttcttcttcttcttcttcttcttcttcttacttcttccttcttcttcttcttcttcttcttcttcttctttttcttctctcctcctcctcctcctcctcctcctcctcctcctcctccttctttcttcttcttagaaagagtccgaggtatcccaggctggcttcaaactcagtatgtatcaaaggctagccttgagctcctgatcctcctgactcttcctcccaaggactggggttataggtgtgtattactgccgttggatgtctttatattttaaagcaaaaatggtatcataatttgtgagttcagaatttatcttcatttaaacatcacttcagaaatcctgatgtctcttgctcacccagcttcccactaaagaactgcagattctcttctgcgtatggtggcatgtctcagaccacccacacaagttgaaaacacagtgagctgaaaaatgtgcagatgccacggcttaatctctctgcccagagtagggatgctatccttcagcacgacatctgctcactatctctagcccaaggaagaaaattacaacttaaaatttgaagtctggttcctattgatcatgtatcttttacagcatcaaaaaaattgaaaagaatctcttcatttgttactttgtgttgctacaagttcttactatgtgactcaagctggcttcaaatttgctattctcctgtcttagccctcccacgtgctatgattaatgtatgtgtacctccatgctgagtggtgattagagccattctaagaccaggggctatcaactctaatatccagttccgtattctctattcttaattgccatttatagttcaagggcagcccacctatggactcatatactagtaaggtaaaaagatgagctgaaatagttacatgtcactcctgatcctcctgccctctctctcccaaggaaccattaccacagactttgtatctgtctctctacaaatcccaggctggaaatcacaatggaaggcaggccaggctggagtggccctaaagagcttcaaccctgtgctcagtgaccttagaccagaattgctctaattttcatagcagagatggcaggactaattctcacattcaagatggctcctattaacctagaattgtatagcataggacctggactgccctcctttgaacctcacgaattatacacctagagctgtacacacacacaaaaaaccctcatcctaacataggaagacacctgtctctttgtcccatgtgacccctttactattaacctacaggtagttctcgacttgccattagataattggataaattaaaaagaaaatcaaatatagttttgtagacattcttttaaatgcttgaagatacagaagtaaccaagttactgagtgtaacccaaattgtttggttttcaaaaagctactggtattgtctggatagatgcctcagagacggagggaaagcagtggctgctcttccacaggactggggtttgattcccagtgcccagatgggttacaattgactgtaactccagtcccaggggatttaatccctttctctggcatctgagggcaccaggaatgcacatggaacagagacacatgaatagacaaagcaccatacactggggctggagttaagagctgataaggggacctgggtttgattcccagtacccacatggtagctgacaaccaactgtaactccagtttgaggggatctcctaccttccactgacctcagatgccaggtaaccacaaggcacacatacgtacatagatagaactagggcctcatgcatgcaaggcaagtaagtgttttgcctctgagttttatcccctgccctcttgtatgctttctctttcctgtttctttatagacagaatcttgtacacacctgcctaccccaggtttcgaacttgcagtgaggacttctgcctctgccccaagagtactaagatgactggtgtagtgcagctgcttatagattgtaagttatcttcttcctttaggagctcagggctatgggtgtagcttagtggcagagggcttgactagcgcatgtcagggcatgggctgtatcctaagcactatataaagttcttaacttttcatttatttatcttgacacacagacacactctctacacatttctggctgtcctggaactcactatgtagaccaggctggccttgaactcaccgagatctgcctgctattgtctcctgagtgctgggattaaagtcgtgcctcaacatgcccaactaagaagaaagtttgtaaggaaagagctagtaaattgaaaatggctggaacaaagagcctggaattgggttgtaaaggtgcccacctggcatgggaaagtacacaaactgcactgtgaagggagtaacaggaaaaattacatctatgacaagaactcggaagctgggtgtggtggcacatgcttttagttctagcaatcaggaggaagagacaggtggatcttcaagggtagccttgcctatttagtgggctccaggacagccagaactacatagtgagacttgtcccccttcccaaagaactccgtactttggaaagagcatgctggcaatcatgatgatctggttggcacaagtgagaatagagattatgatgatcaaaaaagtgttatcacaggtggggacagaaacaaaactagatgcttcagaaatagaggtgagtcgaggaacctggggtgtgtgtgtgactggtgatggaacacttccagagagtggggcaggaacaggatcaacgtttgacaggttttagtgtctgtgagaggtccaaaaatgcacgttagatagtttggaactactgaggggcttctagatggtctggattgtaagtagaagccatcaactgtttatggtgagggtaagagtcctgagaatgggacttttactttattattattattattattattattattattattattattattattagagccagtgattcactccaatccaggctggttcagaatagaattcggttgaatactggcactttaaaagatcacaagggtaaagagacgaggcatccttattaatagggtcaagataacccccccctaagatcttgcagattgtaaagagctgataaacagctcttccgcgtgagcatcgtcatcccccagtttaagagattgagcagttctattctttagcactgttggggagaacagaggtcagattgacagaatgtagcagagagtaggagtgggagtctttcctgacagtgggtcctacttgcttccaataatcacactctgggccacttgcaacggctccttgaaggagccgcggtgcagagggggttaactcagttgtcaggagaaggcaggcgcctaaaaacgtttggatttcaagctgtagacattggcggccttttagtcagagccgcagatagggcgacagcggaggagtgtcgggacaacggaccaagccggcctagggactcgctacagcaccccgcctcctcgcttccgcaagtggagagcgaagagggcaggggcgggtcctgtaatactgaccacgccccttccgctcgctccggggagcgcagctgggcgtggactcaagggcggggtctgcggggcgggacctgcagggtggggccgatggcgcggggcggggctctgaggacagcgacagcccgcgcactgggcaggagttactgctgctacggtcgcccgcgtcttcaaggtctctgcgcttcctcaccggagacctggactcggccgccatgtccgccgcggaggaggttgatggcctgggtgtggtccggccgcactatggctgtgagtgccgagggcttgggggtgcgcgggcgagggaccaagctcgggttttcccaggggctcagccgggcgggtgcgccgggtggcttgggaccgcacggacccggaagagcagctggctgtatggctggtagcaaggttggcgcccgagccttctcgagctccggaggcggcgggtagaaacctggaggcctctgccttcgctaggcgctgcggcaggggagccccacccagctcctccaccggttagttctactgagattggggaagacggcctagggtgaggtggcaggagaactgactgtgcagggcgtgtcctgggcactggacccaggggttctgctcgggcgtggtgggaaggtgctgcccggattgctgcctgcgagggtgacccagggcgcagacccgcgcagcctcaggctagctgcgaggtgcagttttaggcaagcagcttatgctttctcctgctgggttctttctttagcatttcaaaagtaaaattaaaacataaacacacccaaaccggctccccccacttcctcattttctgtgactatccctgcaaccttagtaaactaaccagctgtacgtgggatagtagttacaagaggatccctttgagtcccaggtttagattttatgttttgggaaaagtactttcttaaaggatactttaacacatccagttatgcattggatagtgttataatgtgtgctacgtttgtgaaattagggatgaaaaagatcaaacagtgccttcaaaacctgtccgagaaagagacaggtgtacagagattgataattagatgaggggttgggaatttagcccagtggtagagtgcttgcttagcaagtgcaagtcctcagctccaagaaaaaaaccaataaggtgcaataaagataaatgatgcatgaactaactctaactgggtataaagagtaatgggggtgaagagaagggacttaacaaggccatgggaaggtaggtgctgacttttaaacagaggcttggaggatgcagtgtggggcagggtgagcaagacatgactttgagagggcagacacaaactaaatatggtattggagaacatagggttactgtacgtggaaaaccgagggcatcgaagtgcagaggtggaattgaaagggagaggagaaaagtaaaaaggatttcccgaagtagcccaggctagagtgagaatagctctgattgccttcccaaggagttatcccttgggaagacagtggagaaggcagatggctacaaggtaaagtccacaggccctggagtcaggtgggctgcaaaggcccttgattagccctccgactgagttcttccagcctcagtatcctcagctgtcaaatagtggtgatcacaggatgggtctgggctagagtaggagcatgtgtgtaaactgtgtagtccaggagcttcggttatgaagagaggggagagtgtgaccaacaaggatagactatagttgatgcctcttgaagctacaagaaaatgtagtacatatatatttaaaacacttaaaattttggttccttgataatttcttttttaaagatttatttatttattttatgtatatgagtacactgtagctgtacagatggttgtgagccttcatgtggttgttggaaattgatttttttaggacctctgctcgctctgatcaacccctcactcaggcccaaagatttatttattattataaataagtacactgtagctgtcttcaaacggaaaatcattttgtagtgcccctggctacccatatatccactagttagcctgcctttctaggtgactagccagcaatttgatggcggtggccttcatttattgctgaggaaagttacagagcttggtgtttacactctttcctttctgttttagccgtcctggataatgagaggctcactgcagaggagatggatgagcggagacggcagaacgtggcttatgaatacctttgtcatctggaagaagcaaagaggtatggagggactagttggagagtggcctgggagaaggagctgatgtgctgtgcctttaaaagagttgttttcatttctgtgtatggtttctggtatccatgtatggctgccagtggaggttagaaggccttagatctcccctggggctggagttacagtcacctgatgtgggtggtggcagcccagctctggtcctctgaaagagcagcaagtgttcctaactgccgagctgtctacccagcctccacaggtggctctctgtgtgcattatgttttaggtaagagtgttggcggctggcagttgaaagggtaagtaggtaggataagtgtagagtgtttattcatgggaacaagtgggccgtggtgggttatgatgaaacactctgtcgaacacttgtgcctgctgaaagatctcccacagttgtgtttttcagcctttctgtttgtagtggttgttttgggtactgccagctgtcagaaataacgttttaagttagggtttgatgttcttgatcttctcagtggttcctaattcttcagggttttggtttgtgtattgagccccatctcctggtgactcatggagtgggtattaggtttagggggctggtaagggtggagctgaaaggggctgaggacatacctgagtggtaaagtacttgttgagtgctcaaggtcctgggagacacccagtgccagaagaaaactgcagaaccttcttacgagggtcatgccgtagctatagatctgtccaccagcagcatggtgaggcctttccgcaaactcaatgctgccacacattttttttttttttgagatgggatctcagccctaggctggcctcaaactcatcctgctgctgaggcttctctggtcctcccactagcatctcccaagtgctgagattacaggcatgcgccaccacacccatctcctctgcattctttatgaggaggatactcagctgctgtttatcttctccagatatctcaagaccttgtgatcttaattttagggtgtcagtttgttatcagtggttccttttgttgtgttgcttacatttctttgcaaggttccagagcagataaacacaattataggtcgtgtacactgaagaataatgggagataattgtcatccaggcttagtgaaaaccagggatgttttagatgattaaaacaagagtggaaatttgatttgattgtcaagagctggccaggaaagttggcagtaaatatgagctcctaggcccaagaagcccttcagagctcccttttctttaaagatgacaaaaactgccccagatatggtccccttggcaccctgccctggactctttataagactgaagtagcggcttccctggaactggagttgaaggagattgtaggccaacctaggagttcctaggtgctagaatgggaccggctcttaactccagagaatggaagcttagtacgatggttttggtagtgcccagggagggatgaggcataaagagcagttgctgcccctccgagctgctttccccatgtgatggcaaatggaactgcagggagcaagagaagaaggtactgtgagaaaagggacattttctcctaggaagtttgtaaggggatacaaacacttaagtcctctgccacttaaattgtgaacttctccttgtggaaggtcaaggaatttgtaagctgcagctggtctcagaagccatcttgtgtgctcccttgagccatcgggaatgagaaggaagacatcagcttgctgagtccctctcctacctgtaagagttttacttttccagaagtgcttgaggtttcgagccttgtgcctgctaagtgtggggctccattcctgacactaagtcaacttctgtcccgactagccacctcatttcagtgagaaaaccaaggcctgagctttcttagcctacctgtagcttctcttttagggggaggggtcatgtagcctaggctggcctggagttcacaatgtagctgagaatgacagagccctgagcccagtgccaaacaaagttgtctgccactacacctggcatagtttcccatagttttctggctaaggaatgttcattgtttgcgcagtggtcctcaactgggtatgtggtatgtgcattagaatctcttgcgaaagtttttacaaatgcggataatctgggttttactgccgaacactcagtaagtgtcctactgccgagccataccccagcttcatacctaaatatttcaaataccttaagtgatttagatcggctttcttaccctagttgagaagtaggatattcgtacttttaacacgtttaaattttctttgaatggttttagactctgacctattagaagttaatgatgctcttcacactttctttccgggtgcagcgctggcaacattttatttgcagtacgttagagcatgtccttcctgacaggcgtgttttccgggatagaaaagtagcctgattatgcaacccatcgagagaccactagtccctgaagggtttttcagttggttgtttacgttaggcagtaaagatgtttatgatattcttatttacttccttctttacttaaagctctgggcataatagctgtgtattgccttgttatattctggcaatgtggaaatgttgcctggtttattttaggggagtaaatggtatcaaatttgcattctgtactgttctccctgcacccccccccccccccccaaaaaaaaaacattcaacagccacctctggttagaaaatcagttatggaagagagtgaagaaacctggcaatgttatggtgggagtagtatttctaccgtcgcctaatgtgatgcctgctggccagtccgcatcagccaagatcctctccctgccccgtgcctcacctgggcagctgggtggtgtctgtgtgctcccggggctcattttccctcaagcaaaagcccaagtggccttgttggattggcctggtcctatttcctcccaatttggaggagccccaaggtctggagtttacatcaacttggaggccaggaataaagatgagagagattcaggggagaaaggctccctcatacttctatttataacacctctgcccctcctgctggaggctctacctttagtacagaggcgctattgtgtatcctgaggctctctttctcctgtacctttcacagagtttgttcttggggaaatgaggagtttagagaacgagactgaatgcatggagactgttgtttgtctgtatgtctgtgtgtagagagtagaggatgctgcaggtatgggtttgggtttgtagtttcccaaaaggttaagtgaggacattaagtgtgagtttcagaaaactgtatactgggaatggttgagactctaatgcagagatttctgctttattgtttgaaaagtggcttcagtatggaacttaaactgatgctctaataaaatattttaggatgccaagatatagcagagcaaaggctgtcaagggatgctctttagtgcttacacctatttccttacttatttatgtgtgtatttatggctcttccgattgggcttgacgtttattttagctaaggagtagctgtatgagaaagggatgccatttcatctgttgacggaggtgacattgacctgtgaggtatgtaggtactcgggtcttgagacgagaatgtaacagagacgaatcagaaggtggcttagggagaaaaagagaaggaggcaagagagaatgtactgggtaagccagaggagtcggagagcatgaggggcaatgcaggcaaaggaaacgtcagttagggtaacggtcacacagacagttcattctatactcgtcagtcatcgatttagtcgtgtctttcagggcctttctggtggatccctttgagtcttccctgggctaccttcttcctgagcacccacagcccagcttacagagtgaggacactcccccaactccctctgtagaaaggcaagtacaggctgtggctggctggagattgtctgagactacgtgatattaacaagagcttagcattaactggaagctctttactccacttgaggggaactggagaggtattttggaaagaaaacagcttttgaaaacagattcccttttgtgtgtacatctttgctgttggcatagaacattttctgggttggccttttgagatgcctctccagaatggtattagaattccagaaaaacatctggatatttcccagttcagactcttgattttgaaaacagaagttgggatatttaatttaggcaaaatccctaagtgtataggcaaggtacctaggaaaaccagcatgcctaccagcttttggagttttaagatggagaagtatagcttaaggctgaaggaagaagcagttgtgctacccacagggtaacagcactactcacagtaacagtgttactcacagggtaacagcgctactcacagggtaacagtgttactcacagggtaacagcgctactcacagtaacagtgttactcacagggtaacagcgctactcacagtaacagtgttactcacagggtaacagcactactcacagtaacagtgttactcacagggtaacagcgctactcacagtaacagtgttactcacagggtaacagcgctactcacagtaacatgttactcacagggtaacagcgctactcacagtaacagttactcacagggtaacagcgctactcacagtaacagtgttactcacagggtaacagcgctactcacagtaacagttactcacagggtaacagcgctactcacagtaacagtgttactcacagggtaacagcactactcacagtaacatgttactcacagggtaacagcgctactcacagtaacagtgttactcacagggtaacagcactactcacagtaacatgttactcacagggtaacagtgctactcacagtaacagtgttactcacagggtaacagcgctactcacagtaacatgttactcacagggtaacagcactactcacagtaacatgttactcacagggtaacagtgctactcacagtaacagtgttactcacagggtaacagcgctactcacagggtaacagtgttactcacagggtaacagcactactcacagtaacagtgttactcacagggtaacagcactactcacggtaacagtattacagggtaacagcgctactcacagggtaacagcactactcacagtaacagtgttactcacagggtaatagtggtactcacagtaacagctactcacagggtaacagttttactcatacagcaacagtgctactcacagggtaacagcgctactcacagggtaacagcgctactcacagggtaacagtgctactcacagtaacagtgttactcatacagcaacagcactactcatacagcaacagcgctactcatacaacaacagcgctactcacatagtaacagtgctactcacagctactcacacagcacagagctactaatgtgagttttctttcctagtataactgtcagtcacttttaccagagtccattgtaaactttacagatgtgaagctgaggcagatgatgtgtcacaggcttcagtcctagcactggggatggatgcaggaggaacagacaggccagcctaatctacacagtgaaatccaggccggccagggcaataaagagactttgtcttctaaaaaaaaaaaaaggtgaagctggggctggagaacggcttaatggttacagggattaaagaacacttaagttcagatcctcagaaaaatgccaggtgggtatggcctgtctgtaattccagccccagaaaacagtcgaacactagccatcttctcaagctctgggtttgattgagagaccctgcctcaatgaataaggtagcagagtgatgtcggatgatgattcctgtgataaaccttaggcttccatgttcacaaatacacatgtgcgtgtggccccatatgtgtatacatacataaagagaaatatgaatacacacacacacacacacacacacacacacacacacacacacacacactggaaaaaaaatacaaactgtgaagctgtctgggtagctcgagttgtaactccagcctttgggaggtagagacatggaggactaggaatgagagtcactgtcagcaccatcatctccagcatgagccacaggagactcagagaaatatggagctgggtggcatgtgacctgagccctcggggagactgaggcaggaagatcctgagtttgagggcagcctagactacatagctaggttctgtctaaacaaaacaaaacaggaggcttgtggggttgtgcatgcttacctaacctcaggatttggagactgaggcaggaagattaagaatttgagatcagcatgggcttccaagtgagacctgcctcaaaacaaacaaacaaacaaacaaaccagagcaaagtgaaacaattttaaaagtctctgagtagttactgtcattgctaagtcacacagctgcccccatgttactcacaactgcataaagcacactgaaaaagcctgaaactccttggagtcttggctgctgaggtaactgggccatggagaagaatgttgagatgcttgggtgaactggaaaagattgggactttgaatttgagcaggtataggctttgattccggctttacaagctgtttaaccccaggcagtgagctgcatgactctgcagagggaaaaaaatgttacagagttgctatgggagtcaagtagtagccccgagagatacagaaaacactcaacaaatgcatttttaagagatttacttcttttagtttcttttacatgagggttttgcctgcccatacttgcatgtgggtgctgggaattttaaacccacatcttctgcaggagccttgagccatctcgccaggcccaatggatacattctttaacctggtctgtggccaaagggagatgtaaggatggagggataagacacgttaagcacgttttaccaagtatgtagcctaggttgctatgaatgtggcccaacacattcgggcacaatcttatcacagtggtggaagttagacactcctgtaaggttgggagccctcgtttccactggagacttcagtgatttttggagaggaaacccagtcacagagaagagtggaggtggagggagtaaggaggctgcccttttattgactactatactgctgtatctagcatccctttacactaagatagcaataagggacggcagggatcgagggatgctctgtgtcaagtgcatagttttaggtagttgtatcataagttcaacatttttaaaagattcagtttatttttatagacatgtgcacatgtgtgatggggaggtcagatgagggagttgaacctcctggagctgaacttgtaggcacttatggcctcctgtgtgggagctgggaactgaacgcatgtcctctctaagagccattgagccatctctccagcaccacaaattccaaaatttctcactgtttttaacatctatataaaatttatttagatctatgccaatttaaaacattgctttgactattggctactaagctgaacattttgttacgtttttgtctatagttttatttttatatccagattttctgttgttgtctgcttatcttttatgtcgtctgcttatctttatgttaacttttgtaagctctccagtagtgtgtctgtgtgcacgtacatgtgtgtgtacgtgagtgtatgcacatgtttttgtgggtgagagtgcacatatgctcatatatgtggaagccaggagacaactccaggtgtcaattcctcaggcaaatatccactcttttggagacaaggtctcattgtcctgaggttatgtcaagtaaggctagccctgagattacaagctgctactatgcctggcttttcccttaggttctgggtttgactcagctcttcagtttgtagtgaatgccttcctgctctgcttccctgtgctctggtcacaggtatactcagcctgctaacttctctgtgatttaataactttacttaagattttctttaattgtgtgcgtgtgcgtgtgagacccggtctagctctggacttgcctgtcatggtgagttaaggacttctcttgactgcccagcacttcacttgctttatccgttcttactgagaaactgcagcagttttattttggctccttctcaagaactgtgacttgttaatttttttacttttatagaatttttgttcctttctgattggcattgtgttagcagttttgtctgtaatgtgggcttttcagtgggcctcttttagatgtgtatgtgtgagagacaggcaccttacttccaagtcagtcctcagtcagactctttttgatttataatgtattttaaaagctttccccctcccctttttatttctttttttaaaatttattttatttgtttacattccaaatgttgccctctcttttatttcttaaaattaattttcaagttagcacacacggtaatggggtcattgtctgttgtcatctttctgcagatgtgtcattatattttgtttttccatgtgccctctgccctcctcctggctggtcccttcttgcaatatctttttatttattttagctctaggaaattatccattttacctttaataattgcttctgattcattagttctgtcttgagggtgagctgcacaatctctttatggcttctcttcatttcatttgtttatgtaaagtcatagcaaccaagttgtggcgtaaatcatctgcagtggtcatcctaggtgtgtgttctgctgtctgtttgctgctggcttggtttagttctctctggttctgttgtctgacttcttagagcgttcattttgacctgtaaagtctttctattcttgttagtagttaagagggccttcattagttcatgaagagcagaggggtgcatagcagtccccccagaggtggagaaaaggaggctcatgggaggcgtgggtttgacattttacagttctccttacagacagtgtggaggtggacgtgaccacacaccagtgttaacccggcggctgagtgtacagactgttgaccagtcaagattgagaaagtctttgagagctaagcagcctgttcatttgacctaatttggtatatatttctcctggatttagagatcaaagcagtgattgtgctcatgtattttaaaccccatgagacaaaatggtgaaaatgtatttgaagtcttgagttagcttattctaggaatttcatttcctggtcttgctgggtgatctgtttctgattctttataatttattctgcttcactatgaactagttcagagatacctgttggtagatagcagggccagttttgagtactagtaaatgatatgatattagatggacctctggttgcttctaattggagttgcctaaaataaccctgtgacaagtatttgtgtaaataaagtgctggtaggcaatgtgagaccttcaggaagtgattcatatcactctgctgtttgtttaatttgggactccgttgcttagagaccatatctttgaggaggctgagtgtgaaatactagctgaatgccaagggccaggggctacctgatcaaattaatcacagccctgcttcttcactttagttttagaaggctccttatagtggcttggcagtgtttttattacaaaaattaatataaaaaacatataaatgaaggatctggctaatgatttaatttgaaatgtaaatatttacttaaatttgaattttcaggaaacatttttttttgatagaattggttatttctaccaggcattatatatatatatatatatatatatatatatatatatatatattaaacagactctttccttgtacccctcccatacccatttcttgagaatagacattgtttagatctggaaatcccctactctccccttctcctttctcccctgagggcctataaaaactgggacctctttcccctcgaggtcgactcctctacctctgcatgggatatgagtcgtccccagagctctggctttccccgaataaagcctcatgtggtttgcatcaagcttggtctatcgtgagttcttgggtgtccgctattgtcctgaggcctgagcgaggggctcctcttggagtctttcagttccagacaactggtgtcagctgtcatatggccgaggactggagctgtgtctgctcattaaagtctcatccaccctcaaatgtccagtttgtcttttggtttgttttttatattgagaactgaactgagagtctcacagatgctgggcagattacctgctgctaaaacacaccccaaatcccagtgattagacaaaccagtttgaagcagggtctccttaagtcgtctgggtagcttctggtttcagtccgctgtggttcaggagtaggttgggtttacaggcatggtccaccacacccatttcgtcacgtatttgtgcttttaactggattgttgggctattcctcaccgttttttttttttttttcctacgttctaacctggtctctgcctttgggtttagcttgtgtcccaccagactgtcctttgctaaatagtgacctcatgcagacaggagtggcaagttggattggaaattgccttacatcgttttggcaagagccgtgtttggggggtgtgggtggaggaaggacttgtctgaaggcctctatttcttctttactgagaatgctttcctgttgactcactggaaatcataacgaaaagcagaggaacactggaaaggcagctgccagcccagggctgtgctgctgctgggcagctgctgagggcctggggagacaccaggcgccaagattggtgagatttttgaggagagaaaatagaaggggattctggtattattgtgaaaggtaatttttcaaaaagtatagttatggcccagattgaacttttcttttttaattcaaaaccagagtgtgcctggctgtggtacataattcagaggggatgggagatccagagaagaaaaagcccacctgtctcctcggtcctgtttctcctaccctgtgccatcttttccagttagatggctgttagcattgtcccctgtgtatgccatatgtattataaatatttattccacgttaccctttacacttttatttttgtaaggtgtttatagtaatagcatcttaagacatgtttgaatttattaatcttattttttagcttctgaagtcctcttcaggccattttcatacagtcctagtatatatatgaaattatagaaaatcatttgagtttggagagatggctaaacagttaagagcactaattgttcttccataggacctgaatttgattcctggcacccatactgggtggctcatagttgtcttaattctactttcctgggcatgactcctttggcctcttagatgcctgtaatgatcttgcccatgtgtacttcacaattaatgaaagcaaaataatagcaaaaagcaaaaagaaaaaaaaaaaaaaaaggaggggggtgttgttcaatgtagccatgttgggaagggagacaaagaaagctagcaccacggttcctaaagtcctaaagtccgtcctcaaagggtctgccctaaaggtaggaagcaagatacataactaagcagtccaataagatgtggtccagcccaccatctcagctccaagcctcctgcagggtcatctgaggggcgccagatatttttcctggaaacatgtggatgcccccagggtggcattgtttcctcttttagcaggaaggagtcctgggaactctccagtttcttggggtccattctttcagtaatctgacagccaaagatggagcacacacctctctttaagagcatatcctgctaaacaggttcattacatactcatacatacacacagctaaaaatcacccaaaactaagtcttaaaaatactcccttatggtttcctccccttctcccttcagtaatggagcttgaacacagggcctcgaccatgctaggcaagtattctgctgggctttacttccaggcgagcccctgcctaatagtgttttaaaatatatatatacatgtatatgtagcatcacttaatatttacatgtgtattataatatattaaatatgaatgtatgtaatatatatatacatacacacatgtaacatgtaagtgataaaactggacatgtgtatatatgtgtacacacatatatgcagcgttttaacatttcatttaactctttgattcatttaggattttggcatgaggacttgggtagatatcttatttattttgttttgtttgaggcttggtctcactatgtagccctgggtggcctaaaactaactcactgtgtggaccaggctggccttgcactcagagattcacctgcctctgcctcctgaatgctgagatcaacagtgtgtacccgtgtgtgtgtgtgtgtgtgtgtgagagagagagtgtgtgtgtgtgtgtgtgtgagagagagagagagagagagaggatctaaatgaaagactttcactgtttgggaaatataatcgctgggctgttgcccatcatctttaggacactgtttttgtcaattacatgatctcatgtagccaaggctactcctggttctcctacttgtaccacctaagcactggaactacaggtgtgtgccgtatgcctagcttcttgaggcactgtaaaggacagagttgtgagttctaagagttaggattgcaaatgtactaatcctaattatttcaaacaaaaagaaaacatatcacaaaatctgatctagtgaactaatttctgacaaaatacaggagtggcaaaattccagggtacattatcagatagctgtcttctgaggacttagtaagaccagaatgacatgatgctaggagccaccctggctcctcactgtggactccttcggagagccatgctgcagaaacgtctactcttgaacagggtcaccacattggtgagtcagaaaaacatgtaaagtctagagtgtagcaaggcatttgcaagtgtgtcttgtgatactttgcagagagattggttaaatatgaattagatttcagtgtaattaagatgatttatagctgcctgagtaaaccagatttaaaagggcccttagaggggcgtggctgctagagggatataggtttcttttagggtaatgaaagtttctgggactatattgtaatagtggttgtacaacatagcgagtataacaaaccaaaaacaccacattgcttatggttaaaaagggtgaacttgcaaagtctggctcagaaaaagagcgattggttttgtttggttttgcttttgagatctgtgtagctcacaccagtcttccatgtgttgtgcactgaggatgggtgaccttggccttctggtttttctgtcactgtctctccagtgattgagagctaagcagggcttcatgtgtgtcagaccagcagtctaccaactgagctgcgtacccagccccggcttgtttgttcctttggtttttttgagataggatcctatgtaacccaggctggcctcagactccttgtacacttagaggatgaccttgaactcccgatcctctttcctctaccttcctagttcaggaattacaggtacgagccacctgtcatccctcccagctctagttgctggattttaacgcaacggaagctctttagggcctcttctcacaagggatgtgccagtcaaatttggactgctagagaagtggttaacacaacaaactgtgtttaaaatacaccaggttaccacagtgtaataggataatggtttacgttgtggtagaaaaggtctaactgcagagtaaaagagaagcagcattagtaggaaaagcaaacgacatcagagatacttgttaaccattaagtctggtgacctgcatttgacccttggaagcactgtaaaggtggaaggagagagctgccccagacctcccatgtgcattgtggcctgggatacacatacgtacaataattgcaaattaaaaacaaatcacgaggtggacaggacagcacccaagggatgatgtttgaggttgacctctggccttcacacacatgtgcaagcgtgtgcagatggaccctttctaagagcacatgcacaaagtcggagccactgtgggaacccacgttgtaggagactttcaaacacagatccacagttccagggaagcttcttcctgtgctctaacccatttctgcagtta

SEQ ID NO: 1566 - DNA, 6124 bp, Mus musculus
agcgacagcccgcgcactgggcaggagttactgctgctacggtcgcccgcgtcttcaaggtctctgcgcttcctcaccggagacctggactcggccgccatgtccgccgcggaggaggttgatggcctgggtgtggtccggccgcactatggctccgtcctggataatgagaggctcactgcagaggagatggatgagcggagacggcagaacgtggcttatgaatacctttgtcatctggaagaagcaaagaggtggatggaagcatgcctaggtgaggacctgccgcccaccacagagctagaggagggccttagaaacggagtctaccttgccaagctagggaacttcttctctcccaaagtggtgtccctgaagaaaatctatgatcgagaacagaccagatacaaggctaccggcctccacttcagacacacggataatgtgattcagtggctgaatgccatggatgagattgggttgcctaagattttttacccagaaaccacagatatctatgaccggaagaacatgccaagatgcatctactgtatccacgccctcagtttgtacctgttcaaactgggcctggctcctcagattcaagacctgtatggaaaggttgatttcacagaagaagaaatcaacaacatgaagatcgagctggagaagtacgggatccagatgcctgccttcagcaagatcgggggcatcctggctaatgagctctcagtggatgaagctgcgctacatgctgctgttattgctattaatgaagcgattgatcgcagagttgcagctgacacttttacggctctaaaaaaccccaatgccatgctcgtcaatcttgaagaaggcctggctcccacgtaccaagacgtgctttaccaggccaagcaggacaagatgacaaacgctaaaaacaggacggaaaactctgacagagaaagggacgtttatgaggagctgctcacacaagctgaaatccaagggaatgtaaacaaagtcaacacatcttctgccctggccaacatcagcctggctttagagcagggctgtgcagtgaccctgctcaaggctctgcagtcactggctctgggcctccgagggctgcagacccagaacagcgactggtacatgaagcagctacagagtgatctgcagcaaaagagacagagtggccagactgaccccctgcagaaggaggaggtacaggccggagtggatgctgccaacagtgctgcccagcagtaccaacgacggttggcagcagtggcagcaatcaacgctgccatccagaagggcatcgctgagaagaccgtgttggagctaatgaatcctgaagcccagctgccccaggtgtatccatttgcagctgatctctatcagaaggagttggccaccctgcagcagcagagccctgagcatagcctcacccatcctgagctcactgttgctgtggagatgctgtcatccgtggccctcatcaacagggcgctggagtcaggagacatgaccactgtgtggaagcagctgagcagctcagttacgggccttaccaacatcgaggaagaaaactgtcaaaggtatctcgatgagctgatgaagctgaaggctcaggcacatgccgagaataatgcatttattacatggaatgacatccaggcgtgtgtggaccatgtgaacctggtggtccatgaggagcatgagcggattttggccatcggcttgattaatgaagccctggatgaaggggacgctcagaagactctgcaggccctgcagatccctgcagccaagctcgagggcgtccttgcagaagtggcacagcactatcaagacacgctgatcagagcaaagagagaaaaggcccaggaaacacaggatgagtcagctgtgttatggttggatgaaattcaaggtggaatctggcagtccaacaaagacacccaagaggcccagaggtttgccttaggaatctctgccatcaatgaagcagtagacagcggtgatgttggcagaaccctgagtgccctacgttctcccgatgttggcttatatggagtgatccccgaatgtggggaaacgtaccagagtgaccttgctgaagccaagaagaagagactggcagcaggagataataacagcaagtgggtgaagcactgggtgaaaggcgggtaccattactaccacaacctggagacgcaagcaggaggatgggctgagcccccagactttgtgcagaattctgtgcagctttctcgagaggagatccagagctccatctctggagtaaccgctgcatataaccgagagcagctttggctggccaacgaaggcttgatcaccaagctgcaagcctgctgccgtgggtacctcgttcgacaggaattccgatcccggatgaattttctgaagaaacagatccctgccatcacctgcattcagtcacagtggagaggatacaaacagaagaaggcatatcaagatcggctggcttacctgcactcccataaagacgaagttgtgaagattcagtcccttgccaggatgcatcaagctcgaaagcgctatagagatcgcctacagtatttccgagaccatataaatgacattatcaaaatccaggctttcattcgggccaacaaagctcgtgatgactacaagactctcatcaatgctgaggacccgcctatgattgtggtccgaaagtttgtccacctcctggaccaaagtgatcaggacttccaggaggaacttgatctcatgaagatgcgcgaggaggtcatcaccctcatccgttccaaccagcagctggagaacgacctcaacctcatggatatcaaaatcggactgctggtgaagaacaagatcacgctgcaggatgtggtttcccatagtaaaaaacttaccaaaaaaaataaggaacagctgtccgacatgatgatgataaacaagcagaagggcgggctcaaggctttgagcaaagagaagagggagaagctggaggcctatcagcatctcttttatctcctgcagaccaaccctacctatctggccaagctgatctttcagatgccacaaaacaagtccaccaaattcatggactctgtgatcttcacgctgtacaactatgcatctaaccagcgggaggagtacctgctgctgcggctcttccagacagctctgcaggaggagatcaagtcaaaggtggatcagattcaagaaatcgtgacaggaaaccctacggttattaagatggttgtaagtttcaaccgtggtgcccggggccagaatgccctccggcagatcttggcccctgtcgtgaaggaaattatggatgacaagtctctcaacatcaaaaccgaccctgtggatatttacaagtcttgggttaatcagatggagtcgcagacaggagaggcgagcaaactgccctatgatgtgacccctgaacaagccttgtctcatgaagaagtgaagacgaggttagacaactccatcaggaacatgagggctgtgacagacaagttcctctcagccatcgtcagctctgtggacaaaatcccttatgggatgcgattcattgccaaagtcctgaaggattcacttcacgagaagttccctgacgctggtgaggacgagctgctgaagattatcggtaacctgctttactaccgatacatgaacccagccatcgtcgctcccgatgccttcgacatcattgacctgtcagcagggggccagctcaccacagaccagcgcagaaacctgggctccattgccaagatgctccagcacgcggcgtccaacaagatgtttctgggcgataatgcccacttaagcatcattaatgagtatctctcgcagtcctaccagaaattcagacggtttttccaattggcttgtgacgtcccagagctgcaggataaatttaacgtggatgagtactctgacctagtcaccctcactaagccagttatctacatctccattggcgaaatcatcaacacccacactctcctgttggaccatcaggatgccattgctccagagcataacgaccccatccacgaacttctggacgaccttggggaggtgcccaccattgagtcccttataggagaaagctgtggcaattcaaacgaccccaacaaggaggctctggctaagacggaagtgtctctcacgttgaccaacaagtttgacgtgcctggtgacgagaacgcagagatggacgctcggaccatcttactgaatacaaaacgtttaattgtggatgtcatccggttccagccaggagagaccttgactgaaattctagaaaccccagccaccaatgaacaggaagctgaacatcagagggccatgcagagacgggctatccgcgatgccaaaacccctgacaagatgaaaaaatcaaagcccatgaaggaggataacaacctcagcctccaggagaagaaagagaagatccagactggcctaaagaagctaacggagcttgggacggtggacccaaagaacagataccaggaactcatcaacgacattgccaaggatatccggaatcagcggagatacaggcagaggaggaaagctgaattggtaaaactgcagcagacgtactcggcgctgaactctaaggccaccttttacggcgagcaggtggactactacaagagctacatcaaaacctgcttggataacttggccagcaagggcaaggtctccaaaaagcctagggaaatgaaaggcaagaaaagcaaaaagatttctctgaagtacacagcagcgaggctgcatgagaagggcgtccttctggagattgaagaccttcaggcaaaccaatttaaaaatgttatcttcgaaattggtccaacagaagaagttggagactttgaagtaaaagccaagttcatgggagttcagatggagactttcatgttgcattatcaggacttgctgcagctacagtatgaaggagttgcagttatgaaattatttgatagagctaaagtgaatgtcaacctcctgatcttccttctcaacaaaaagttctatgggaagtaatgggtcgctcgccgcccagaagagttaacaaaaaacggcagcacctcacggctgtctttctaggatcctccattattccttagaagcaaggacctggtccagtggcggtgcctcagttcacactccctctgacggacggacggacgtcagtgccctctcccttctccttgtgaagccataagcctgacttcccctcagccctgctccctcattttctctcatcatgtaggaaagagtgggaccccctcccaacccctttctgttaaagcctcctaagtggtcattactactttgtagacattggtatttgttttacttagcaataagaatggtgaaattcaaattctcgtttagaagtgaaagctgtcaggttgatagcaagcatgcacatcaaattcaccagaagtacaacccatcggcgcagtcagaggatggagtctgatgtcttccggctgctgcctttgtgggcagagctaatccaagttactgttctctgttcaaatgaagcagcttcaggagaaaaagagcaattacttttgaattctccaataaatctggacaatgccgttagcgaagagcccttcctggtgaaggcaaacccatggtcagagcaggccatttagagactgagtgggcggggcacttaccatcccttccacaaaggatagcttcccccagctcaaaatgtaactgtttctaaactgtattccaagagtgccttaccaaagtataaatttatttcttaaaatgtgagtaataggaattttaaagatttatataatgcttttgaacactctgagaaagggttgttttttttcattgggttaatctgtatatctgaattcttgaagcttttctctagcctacagtagggtcgatctgccgagctgctgaataaccctgcttgattttagcaacaagagacaatccatgccatgcttttatcctgagaaacctggacccttaggctctgactaacaaagacagttcagctccagacactgaacttggaatcctttgtctttggattaaaagtcataaacttaaaaaa

SEQ ID NO: 1567 - DNA, 4974 bp, Mus musculus
atgtccgccgcggaggaggttgatggcctgggtgtggtccggccgcactatggctccgtcctggataatgagaggctcactgcagaggagatggatgagcggagacggcagaacgtggcttatgaatacctttgtcatctggaagaagcaaagaggtggatggaagcatgcctaggtgaggacctgccgcccaccacagagctagaggagggccttagaaacggagtctaccttgccaagctagggaacttcttctctcccaaagtggtgtccctgaagaaaatctatgatcgagaacagaccagatacaaggctaccggcctccacttcagacacacggataatgtgattcagtggctgaatgccatggatgagattgggttgcctaagattttttacccagaaaccacagatatctatgaccggaagaacatgccaagatgcatctactgtatccacgccctcagtttgtacctgttcaaactgggcctggctcctcagattcaagacctgtatggaaaggttgatttcacagaagaagaaatcaacaacatgaagatcgagctggagaagtacgggatccagatgcctgccttcagcaagatcgggggcatcctggctaatgagctctcagtggatgaagctgcgctacatgctgctgttattgctattaatgaagcgattgatcgcagagttgcagctgacacttttacggctctaaaaaaccccaatgccatgctcgtcaatcttgaagaaggcctggctcccacgtaccaagacgtgctttaccaggccaagcaggacaagatgacaaacgctaaaaacaggacggaaaactctgacagagaaagggacgtttatgaggagctgctcacacaagctgaaatccaagggaatgtaaacaaagtcaacacatcttctgccctggccaacatcagcctggctttagagcagggctgtgcagtgaccctgctcaaggctctgcagtcactggctctgggcctccgagggctgcagacccagaacagcgactggtacatgaagcagctacagagtgatctgcagcaaaagagacagagtggccagactgaccccctgcagaaggaggaggtacaggccggagtggatgctgccaacagtgctgcccagcagtaccaacgacggttggcagcagtggcagcaatcaacgctgccatccagaagggcatcgctgagaagaccgtgttggagctaatgaatcctgaagcccagctgccccaggtgtatccatttgcagctgatctctatcagaaggagttggccaccctgcagcagcagagccctgagcatagcctcacccatcctgagctcactgttgctgtggagatgctgtcatccgtggccctcatcaacagggcgctggagtcaggagacatgaccactgtgtggaagcagctgagcagctcagttacgggccttaccaacatcgaggaagaaaactgtcaaaggtatctcgatgagctgatgaagctgaaggctcaggcacatgccgagaataatgcatttattacatggaatgacatccaggcgtgtgtggaccatgtgaacctggtggtccatgaggagcatgagcggattttggccatcggcttgattaatgaagccctggatgaaggggacgctcagaagactctgcaggccctgcagatccctgcagccaagctcgagggcgtccttgcagaagtggcacagcactatcaagacacgctgatcagagcaaagagagaaaaggcccaggaaacacaggatgagtcagctgtgttatggttggatgaaattcaaggtggaatctggcagtccaacaaagacacccaagaggcccagaggtttgccttaggaatctctgccatcaatgaagcagtagacagcggtgatgttggcagaaccctgagtgccctacgttctcccgatgttggcttatatggagtgatccccgaatgtggggaaacgtaccagagtgaccttgctgaagccaagaagaagagactggcagcaggagataataacagcaagtgggtgaagcactgggtgaaaggcgggtaccattactaccacaacctggagacgcaagcaggaggatgggctgagcccccagactttgtgcagaattctgtgcagctttctcgagaggagatccagagctccatctctggagtaaccgctgcatataaccgagagcagctttggctggccaacgaaggcttgatcaccaagctgcaagcctgctgccgtgggtacctcgttcgacaggaattccgatcccggatgaattttctgaagaaacagatccctgccatcacctgcattcagtcacagtggagaggatacaaacagaagaaggcatatcaagatcggctggcttacctgcactcccataaagacgaagttgtgaagattcagtcccttgccaggatgcatcaagctcgaaagcgctatagagatcgcctacagtatttccgagaccatataaatgacattatcaaaatccaggctttcattcgggccaacaaagctcgtgatgactacaagactctcatcaatgctgaggacccgcctatgattgtggtccgaaagtttgtccacctcctggaccaaagtgatcaggacttccaggaggaacttgatctcatgaagatgcgcgaggaggtcatcaccctcatccgttccaaccagcagctggagaacgacctcaacctcatggatatcaaaatcggactgctggtgaagaacaagatcacgctgcaggatgtggtttcccatagtaaaaaacttaccaaaaaaaataaggaacagctgtccgacatgatgatgataaacaagcagaagggcgggctcaaggctttgagcaaagagaagagggagaagctggaggcctatcagcatctcttttatctcctgcagaccaaccctacctatctggccaagctgatctttcagatgccacaaaacaagtccaccaaattcatggactctgtgatcttcacgctgtacaactatgcatctaaccagcgggaggagtacctgctgctgcggctcttccagacagctctgcaggaggagatcaagtcaaaggtggatcagattcaagaaatcgtgacaggaaaccctacggttattaagatggttgtaagtttcaaccgtggtgcccggggccagaatgccctccggcagatcttggcccctgtcgtgaaggaaattatggatgacaagtctctcaacatcaaaaccgaccctgtggatatttacaagtcttgggttaatcagatggagtcgcagacaggagaggcgagcaaactgccctatgatgtgacccctgaacaagccttgtctcatgaagaagtgaagacgaggttagacaactccatcaggaacatgagggctgtgacagacaagttcctctcagccatcgtcagctctgtggacaaaatcccttatgggatgcgattcattgccaaagtcctgaaggattcacttcacgagaagttccctgacgctggtgaggacgagctgctgaagattatcggtaacctgctttactaccgatacatgaacccagccatcgtcgctcccgatgccttcgacatcattgacctgtcagcagggggccagctcaccacagaccagcgcagaaacctgggctccattgccaagatgctccagcacgcggcgtccaacaagatgtttctgggcgataatgcccacttaagcatcattaatgagtatctctcgcagtcctaccagaaattcagacggtttttccaattggcttgtgacgtcccagagctgcaggataaatttaacgtggatgagtactctgacctagtcaccctcactaagccagttatctacatctccattggcgaaatcatcaacacccacactctcctgttggaccatcaggatgccattgctccagagcataacgaccccatccacgaacttctggacgaccttggggaggtgcccaccattgagtcccttataggagaaagctgtggcaattcaaacgaccccaacaaggaggctctggctaagacggaagtgtctctcacgttgaccaacaagtttgacgtgcctggtgacgagaacgcagagatggacgctcggaccatcttactgaatacaaaacgtttaattgtggatgtcatccggttccagccaggagagaccttgactgaaattctagaaaccccagccaccaatgaacaggaagctgaacatcagagggccatgcagagacgggctatccgcgatgccaaaacccctgacaagatgaaaaaatcaaagcccatgaaggaggataacaacctcagcctccaggagaagaaagagaagatccagactggcctaaagaagctaacggagcttgggacggtggacccaaagaacagataccaggaactcatcaacgacattgccaaggatatccggaatcagcggagatacaggcagaggaggaaagctgaattggtaaaactgcagcagacgtactcggcgctgaactctaaggccaccttttacggcgagcaggtggactactacaagagctacatcaaaacctgcttggataacttggccagcaagggcaaggtctccaaaaagcctagggaaatgaaaggcaagaaaagcaaaaagatttctctgaagtacacagcagcgaggctgcatgagaagggcgtccttctggagattgaagaccttcaggcaaaccaatttaaaaatgttatcttcgaaattggtccaacagaagaagttggagactttgaagtaaaagccaagttcatgggagttcagatggagactttcatgttgcattatcaggacttgctgcagctacagtatgaaggagttgcagttatgaaattatttgatagagctaaagtgaatgtcaacctcctgatcttccttctcaacaaaaagttctatgggaagtaa

SEQ ID NO: 1568 - DNA, 28670 bp, Homo sapiens
ccaagggaaggatgcggaatgtctgttttctactaagggcttctgctgggcctttccaatgtccagtttgagttggtctgggacctggcctccgcaaacaccctgcaggctccggccgccggggatgaggtggaagactgggcagaagagaggccgcaaaggcccgagggctgagctgctctgcgctggggaggggcgaagtgccagagcgcgggagacctcatggtgggcaccaggctgctccgcggtaggtgggtgaggccaggagattcacatctgcagatgccacagtgaggatacagcatttagatccctcggctccaaacaggcggttccgggggaccggtagctggggaattgggtttagcactttccaacgcttggaactggacatccacggctccgagtcctttgaggtcttgctcgggactacgtttcccagaaggctaggcgataattgacagctctatcagcctatggacagagaaaaattctagccatggaaactgaaaagccaatagcaagaggatgggggcggtactttccggccgctggctgtcgaagccggagtcccacctgtgtccccacagccctgtcacgaatcccggtcgggttctgggaggcacagcctcggggttgcgggccgggtgcggctcggcggtggaggactcacttcctgctccatccccggctgggccctggggcggtgagtgattcaaggagggagaccgcggcggcagcggcgcgctgctgaggggcgtggagggggcttgcccgccacccagacgttttctcagcggggttcccgcgctggcctttgggagcccccgggtcttgctgggctgtgggagaggtagctgtggtctctataccgtcggcgggataagtcattctcttaatcagttttcttgcttctcgatggtggtcccagggtttcagctgatctgtgaccctctgaccgccgcaccccggttagggcgcgagcaccgagaagaagaacggggttcggccccacgcgtgcagtcatgttcctattaataaacccggtgaacgcactggagcttctcacagtggcacttagtcacagcccctcagcgctgtggggcctttgaggtcacctgtgcatggggaaagggacgggctgggaaacagggtttctataaccgtggctaagacgtctcccctcctcagtggcgctgtctccagcaagtgggccctgcagctgtgttttgtaatgaatgtagaaataaaaattatactcaaaactcttttttttttttagacggaatttcgctcttgttgcccaggctggaatgcaatggcgctatctcctttcactgcagtctccacctcccgggttcaggcgattctcctgcctcagcctcccaagtagttgggattacaggcgtgtgccaccacacccggctaattttgtattcttagtagagacagggtttcaccatgttggccaggctgatctcgaactcctgaccccaggtgatccgcccgtctcgtcttcccaaagtgctgggattacagtcatgagccacagcacctggccaatactgaaaactcttattacaatttttactttctaattacattattgttgtttgttaaagttttaaaccagagagatggtttttagatccttaaaaactcaatactttataaatgaccaataataatgtctgtaaatacaaaaatatttcccccaaaagtgtgtgtgtgtgtgtgtgtgtgtgtgtgtgtgtgtgtgtgttccagtagtaaataggtgatttgtagtgggacaaaagatgtgaaagagtaaaacttcttcaccacagtctggtccttcctcccttgaaatgcaatattctttgtagtgggtggtcatgctggctgcattttttttttttttaagggagagacaggggctcactctgttgctaggctggggtgcagtggcgccatcatagctcactgcagcctggaactcctgggctgaagtgatcctcccacttcagcctcctgagtagctgggaccacaagtgcatgccaccatgcctggctgatttttaaaagttctttgtagagaaagaggtctcaatatgttgctgaggctggtttattggaaactttttaagggaaaaaacattatcttaatttctatgtgactcctatgcctggcaacatattaattgttgaataaatgactgatccatccagtaattcactcttgactatcctccaaaaagtaatgtttttcatgatattgctgtcgatttattaatatattaatgattggtttcagcccctaagagttgtgttttgtgcttattcccactttcacttatttttacaacctatccatgtcttcttttttttaaaaaaaaaatgtctttttcagtcttatttctgactccattaagatcttgaaatagaatggtatccaacacagttccctttggggttctgtataatctgtcccttgaggttgacaccaaatctgcaagccaagaagttagctgctcccataactaatatgagtatagttaaggccacaatttccttgcttgctgaggaaaatgaagttggggagaatcaaaagctttccagaaatcaaattacacctgccaactctctcctttgtttaccttgttcatcgtggacaatttgttcctcaaaaagtcaatgtgtctaaaagactgggttctgtcgatgtgtttgggaggcctaggcctctcttagtaatgggaaagttggccaggagaagacgtatgtaaaaacagacttagaaaagcacccctctgtggttgacagaatttacctcaggaccattctggtcaggtgtggggggttgtttgtgtacactggtggccattttttggctttcagacaatggtgagaatatctagggagctactgatgcacattgaggtctcttgctttaggaactgatgacgcttgataatgtggctggggacttcagggaagagtgggttacctggacactgcttagagaatcctctccaggaatgccacccagcacagttagaagaatgggctctcaaagggtaagaatgctactctcctttatttcatttatttatcttgttttttttgagacggggtctcgctctgtcatccaggctggagtgcagtggcgcgatctcgattcactgcaatctgtgcctcctgggctcaagcgattctcccacctcaacctcctgagtagctgggatcacaggcatgtgccaccatgcctagctaattttttgtgtttttagtagagacaggattttgctatgttggcaaggctggtctcactatgctgtccaggctggtctcaaactcctgagctcaagcaatccactggcctccgccttccaaagtgctaggattatgggcgccaccatgcctgaccactgctctcctttaatttgagacttagatatttggagagggcccaggtctgaggagtttctggtatgttggcatcttagagctccagacctctgtaagattaattgttgcctccttgggagaaaaacaattacttccttatgcattttatggtttgcaaatgtctttgctatttattgtccttttaatatctcatcataactttttgacttatgtattactatcccccttttccagcctgggttggactctcacctctgccacttaacttctgagacttctgaggtctttgtggaaaaggaggtaattttttctgtcacttaaaaacaggctgggggcagtggctcacgcctgtaatcccagcactttggtaggctgaggtgggcggatcataaggtcaggagttcgagaccagcctggccaacatgatgaaaccctgtctctactaaaaataaaaaaattagctgggtgtgatagcgggcgcctgtaatcccagctactctggaggttgaggcaggagaattgcttgaacctgggaggtggaggttgcagtgagctgagaccacgccattgcactccagcctgggcaatagagcaagactctgtctcaaaaaaaaaaaaaaaaaaaaaaacaaggctgggcgcggtggctcatgcctgtaatcccagcactttgggaggccaaggcagggagatcacaaggtcaggagatcgagaccatcctggctaacatggtgaaaccccgtcttactaaaaatacaaaaaattagccaggcatggtggtgggcacctgtagtcccagctactcgggaggctgaggcaggagaacagcgtgaactgggaggcggagcttgcagtgagccaagatcatgccactgcactccatcctgggcgacagagcaagactccatctcaaaaaaaaaaaaataaataaaaaaaaccaaaaacacctccaatgctctttctcaaatatcatggctacccttcctcctgctttatatttttagtagagatgggttatctccatgtggtcaggctggtctcaaactactgacctcaagtgatccgctcacttcggcctcccaagtgctgggattataggagtgggcccagctctaatttttgtatttttagtggagtcgaggtttcaccatgttggccaggctggtcttgaactcctgacctcaagtgatccgctggccttggcctcccaaagtgctgagattagaggtgtgagccactgcgcctggcctacttcatctattatacaagtaatgtatactcattcaataaaaagtcaagcaaaatgaaaacaaacatcatccctaatcccaccaatgaagagttactatcctaccagcatttttctaagcatatatacaattttaaaagaagcacaaaagaataatattgggattatgctgtatattcagctgtacattctttcttccatgttgtattgtgagtatatctttctttacatcacttaaaataaccacctagtattttgttttatggaatacaatattattttgttgatgaagtcaaacattagattgaaccatatatctgacctttttttaacctataaaaatagcaattgcctgagctacttgggaggctgaggcaggaggatcccttcagcacaggagttcgaggctgcagtgagctatataattattcctttgttgtgggacatttaggtcatttctaaactttcaccaggttgtgataaacatcttttagctcgttttttaaaaagtattttttattgaagtataattttatcattttcttagaattctcagaattagaattggtgggtcaaagaacagatacatttctaaggtatttaatactttgcaaaatgccttccaagaagattgaatcaattgatttattcccacaaacattatatgaaagtgcgcatttctttatattctacctttcacagtgggtattataatttaaagagtctgggcctgggtgtggcagctcatgtctataatcccagcattttgggaggctgaggcaggaggaccacttgagctctggagttccagaccagcctgggcaacataatgagaccctgtctctacaaaaagttacattaaccaggtgtaggggcttgtgcctctggtcccagctacttgggaggctgaggtgagagaatcgcttgagccaggagctcgaggatgcagttaactgtgattgtaccagtgctctccagcctgggtgacagagcaagagcctgtctcaaaaacaaacaaacacacacacaaaacacaaaaaaagagtctgggaaaaatagcaataatagttaacatttattgaagttttttttggagatggagtctcaatgtgttgcccaggctggaatgcagtggtgcaatctcagctcactgcaacgtccgcctcccaggctcaagcaattcccatgcctcagcctcccaagtagctgggattacaggtgtgcaccaccacacgtggctaatttttgtatttttagtagagacaggatttctccatgttggacaggctgctcttaaactcctggcctcacaagtgatccaactgccttggtctcccaaagtgctgggattacaggtgtgagctactgcacctggccaatggatcttattcttatcccaatttttttttttttttttgagatggagtctctctctgtcgtccaggctggagtgcagtggtgtgacctcgattcaccataacctctgcctcctgggttcaagcgattctcctgcctcagcctcccgagtaactgggactacaggcctgtgccaccatgcccggctaatttttagtagagacggggtttcactatgttggccaggctggtctcaaactcctgacctcgtaatccgcctgcctcggcctcccaaagttctgggattataggtgtgagccactgagcctggcctcttatccctattttattgatgaagacattgagacacagagtttaagtaactttcttaaggccacacagcttgtaagaggcaggatgatgactcagacccaggcagtgtgactcttgagtttgcactcattacctctacactatattgcctcagtgtatcattgttataatggaatttctttgattatagtgaggttaaacatttttcgtatatttacaggctacttaacaactgtttgtctttttctcatggcttttttgactgctgccattctgggaaaattttaaagcccaacattatagttaacttccttcattgtttctaagggtgaggtcatggaggcttggtttctgataaaatcctctccatatttagctttagccttgtaccttcagaaatggttattgtatttacttcagagtttctgtcacctgagtctggttttttttctttatgggaggaaaagggcttttttttcttaacattttggggaaatcaccgtgttttatcactgtaccatggctgcacttttttaatgacaccaaatacacgttagagctccccaggtgttcttccatacctaggcagggagtagggcttggattttgctcaggccttgtgtgattggctcagactcacatcctatgtttacattcctgtgtagaatttccaggcctagtgtaatctcccagccggagcagaaagaagagccatgggtcctaccactccaaaactttgaggcgaggaagatcccgagggaaagccacacaggtgagatgtgagtgctccccagtggaaggaaatctagcatttcagccttgtttagatgaagaatttggaatgctgccttagaattttgttcttactagcagacattttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccactagcagacatttaaatttgacttaatggtcagtagttgactaaataaagtcttcattttgattaagcatttcacttttgtctaacctatgtttttttttgagatggagtctccctctgtctcccagcctggagtgcagtgacacaatctctgctcactgcaacctccgcctcccgggttcaagtgattgtcctgcctcagcctcccaagtagctgggactataggcacccgccaccacgcccagctaattttcatatttttagtagggatggagtttcaccacgttggccaggttggtctcgaactcccaacctcaagtgatctgcctgcctcggcctcccgaagtgctgggattataggcgtgagccaccacgcctggcctaaacctataatatcttctaaagaaaccgcacaatattgacaatatgtggtctccgcttgaaggatatcaagattcatctggccatcttaaaatttaaaaagtttaggaattcacgtgttctgacagctcaatgaacctcaataaacttttcacaaagtgaaaacagagcggttgaattaagtgcagtctgctgcagaaacagggattttaatctttgtcactgctttctgatattccttcctgataactgataactttattctctgttacttacattaatttttcagactgtgagcatcaggtggcaaagctcaatcaggacaattctgaaacagcagaacaatgtggaacatcctcagaaaggaccaataaagatctttctcatactcttagttggggaggaaactgggagcaaggcctagaattagaagggcaacatggaacccttccaggagagggccagctggagtccttttcacaggagagggatttaaacaagctcctggatggatatgtaggagagaagcctatgtgtgcagaatgcgggaaaagctttaaccagagttcctatctcataagacacctaagaacccacactggcgagaggccctatacgtgcattgagtgtgggaaaggcttcaaacagagctcagaccttgtcacccatcgcagaacacacacaggagagaagccctaccaatgcaaggggtgtgagaagaaattcagcgacagctcaacactcatcaaacatcagagaacccacacaggggagagaccctatgagtgcccagagtgtggaaagacttttgggcggaagccacacctcataatgcaccaaagaacccacacaggcgagaagccctacgcgtgcctggaatgtcacaaaagcttcagtcgaagctcaaatttcatcactcaccagaggacccacacaggggtgaagccttacaggtgtaatgactgtggggagagttttagccagagctcggatttgattaagcaccaacgaacccacacgggagaacggcccttcaaatgcccggagtgcgggaagggcttcagagatagttctcattttgtagctcacatgagcactcattcaggagagaggcctttcagttgtcctgactgccacaaaagcttcagtcagagctcacatttggtcacgcaccaaagaacacacacaggtgagagaccttttaagtgcgaaaactgtgggaaaggattcgccgacagctccgccctcattaagcaccaacgaatccacaccggagaaagaccctacaaatgtggagagtgtgggaagagcttcaatcagagctcccactttattacccatcagcgaatccacttaggagacaggccctatcgatgtcctgagtgtggcaagaccttcaatcagcgttcccatttcctcacacaccagagaacgcatacaggagaaaaacctttccactgtagtaaatgtaacaagagcttccgtcagaaagcgcatcttttatgccatcaaaacacccatttgatttaggaagtagtctttggtgttcagctgctcccttgcacattttcattgctactgtcttcaagcaccccaaatagagaaaacctgggcgtcagtggctcaatttgggccctgatctattctccctctttcttgtctatgttataacagagaggataaacttaaagggtccaaataacggtccgaatacaaaaggcattccttcagtgtgtgactgactcttagggaaatgtgagtttaatagttgatgcccgccaggcgtggtggctcacccctgtaatcccagcacttttgggaggccaaggtgggtggatcacttgaggtcaggagttgagaccagcctggtgagcatggtgaaacctcatctctactaaaaatgcaaaaattagctgggcatggtggcacgtgcctgtagtcccagctactcgggaggccgaggcagaagaatcatttgaactcagaaggtgcaggttgcagtgagttgagatcatgccactgcactccagcctgggcaacagagagagactctgtctccaaaaaaattaaaaagttgatgcctagttactaaatgagaagtgagaaaaatgtggcctagagatcacatgttcaccacctagtacagtgcctggcacaacatagatgctcaataactaaatggtcccatcattattaatgattaatagttgaggtcttatataaaggctttaatgcagtacctggcccttaaaagacactcagtacaagattggtggcttttatcagtcttattactcaattagaaatttattagtgtagtccccccgccccaaactcagaacgtgaaagaaattagattggaactagaaggtttggggttggaatacacaaattgaataaaatggaaatgcactgccagttcagtgctgtgcaggcattagtcaccagaggtctcactgccatgacaaggccaaattatcgtagaggatgtttgcggtcttgtgacttggaggctgaaagaatttcagaagctcttttaaatggcagtgtatggcagtgtatctaccagaggtttgctgtcatctgacacagagaaaatatcctacaatgaacaagccagagggacctggtagaggactataaaattgtggaagcaaaattgctgagaatgtcaaatgatattacagggatcctccctggcatttagctgaaggaagcaactcttgttttctaatttgctgggtcattggccatttagttttaggttaatataattctctgatccttttagggccatccaggttatgcactagtacattcctacattcaattgaaataaattgagggacggcaagtgtgttggaaagaacaccgacttcattgagaaggtaaagtatttgagtcctggccctgacgcttaatttggccagactttcatcttctcccagcctcaagttttacctacctcacaaggttgttgtgaggatctaaaaatacacacacacacacacacacacacacacacacacacactttgttggttaactataaatgtaatatctctatgttataattctgttgctaatgtcttttttccaagaaaattttggctaatatttctttaggtattcctttttctctcatagtgagggattaaaaaaaaaaaaaactgttgaaaaattagggcgtaaaaatgctaaatgacatgactcatcatgggccacgtagttaacagaagagccagatttggctgcaagtcactagatttccagcctgcagtcctcctctgcaacaacagaccagctctgggatttgttacagtgcctgtgagacattacaggactggaggacccatattatatccattaaaccagtctgaatttggaaatgatggagggtgtagtctaagttgtagggagctttgcaagaacctgtgctggggtccttgatcctggtggaatgggggtggaggagtgagcgcaaatgcaaggggttaaggagggagctgggtagttatcactttttagagtgcaaagtggtggattaaaggtttcttttctttcattctcttccattatatggaatgccatctgagtgctgtggctcatgaaggatagaactcagctgataaccttacctcagtttttgaaagcatcattagataattgaccagaaaattttttttagttaatccagtgcagtggttctcaaactgtgagcccagtccagtagcatcagcattatctgggaactttttagaaatgcagattcaggccgggtgcagtggctcacacctgtaatcccagcactctaggaggccgaggcgggtggaccacctgaggtcaggagtttgagaccagcctggccaacatggcaaaaccccacctatactaaaaatacaaaaattatcccaggtgtggtggcatgtgcctgtaatcccaccaatttgggaggctgaggcaggagaatcacttgaacccaggaaaggaggctgcagtgagctgagatcacacatgctggagtgcaatggcatgatcttggctcactgcaacctctgcctctcaggttcaagcgattctcctgcctcagctcccggagtagctgggattacagatgcatgtcaccatgcccagctaattttatatgttaagtagagacggggttttcaccatgttgggccaggcgggtcttgacctcctgacctcaggtgatccacctgccttggcctcccaaagtgctgggattacaggcgagagccacctcacctggccacctatcactttgattttcatgttgtttggctatggtaaaatgtgagctctcgaagggcaatgtgagatttgctttgtggccctgccaatcccctccctcctccctgtcttcctgcccacccccccccactcccccgccagccatgagcagggaatatttcaatgctattgctgagagtggaggtaaccctttctatagttttcttttgtttctacctcatgactagatgattcactgcttgaacatgctccacacatccgttctttctcactccaaaattgaggtcatcaccaagccccattaattttacctcccagattcctctcgaacctatctgtcaaatctgtccatcttcactgccacccttcagtaccaaatgaccagtctcttacctgaattcctgtagcagcctccaaactgatcttcctgatatgatttttgctctgaaaaaactggtttcactcacagaaaccagagtgaacttttaaaatcctaaatcgaatcacatcacttctcagcagctttccattgcttttagaatgaagacccaaatccttacccaggcctaagaggcccttgtggttttgtcccctccccctccatcctcttgtgatatccccttccctctcccttgcctcacctcagcactcttgagttctctgctccttggtcatgccaaggttgtgtgctctttagacccttggtactaactgttccctctgcccagaatgttcctcgcccagtcctttgtgttgcctcctatttgtcaaccaggtttcagcctaaacctatctccttaggaagactttccctaactatcccatctaaattagtcaccctccatcacattatcctcttttttcatcaaagtccttacacctgtctggcaatttcttattaattgatttgtttttggtaaactccacgaaaggtgggagtcatttctcttgtttccattctttccacagcacttagaacagtgcctggcacatggtaggtgctcaatatgtgtttactggatgaattaatgagtgcatgctcatgggcaaggatctcattgtgctggaaaagcagcagagtgagacaaaactggacaggtgagtgaaggtcacaccaagaaggttcttagctgccaaactaaagggtttggatcttactctctggagaaaagggtgtagctagtggttttataggagaggagaggcgcgatccgcacttgagaaggtcaatttggccgctgtgtgtaggtcatattacggagaaaaaaactaaaggctttgagacaatccatgatgtaaagggcttagcacagtgcccagcacgcagtaggtctccagcgagtcgttatcaccaagcaccagggcaggcaccacaacaaaaagataagatccctaacccttcttttacctcgaaataattcctcctagaccctatcatcgcattccttctcttccccttttgtcaaacttccactcacatgtagatattctcagggttatcatgcctaggcctttttaatagggccacttaccctagcatgcttctacaactggaccctcaaaggtcttttagggctgagtgtggtggctcacacctgtaatgccagcattttgggaggccgaagccagaggactgcttgagcccagaggttcaagaccagcctgggcaccatagccagaccctgtctctacaaaaaatagtttcaacaaattagccaggcatggtgatgtgcgcctgtcatcccaagtacttgggaggctgaggtgggaggattgcggattgcctgagcccaggagttcaaggctgcagtgagctgtgatcataccaccgtactccagattgcgtgacagagctagaacttgtctcttaaaaaaaaaaaaagacttaatttccacatctgaaggcctcttgttagtcttcttctgattcaacaactctttactgtttgatgccatttacatatgtttattattttttagagatggggtctcattcttttgctgaggctggagagcagtggtgcgatcatggctcactgcagcctcaacctcccagactcaagcaatcctcctgtctcagcctcctgagtaacagctaggactacaggcacatgccaccaaacccggccttttaaaatttttggtagaggccagatgtggtggctcatgcttgtaatcccagcactttgggaggtccaggcgagtggatcacctgaggtcaggagtttgagaccagcatggctaatatggtgaaaccccgtctctagtaaaagtacaaaaattagccaggcgtggtcgtgggcgcctgtgatcccagctactcgggaggctgaggcagcgagaatcacttgaacctgggaggcggagcgttgcagtgagctgagatcgtgtcattgcactccagcccagctgacaagagcgaaactccatcgcgggggatgataataataataataataataactttgctagagacagggttcccctatgttgcccaggctggtcttgaactcctgacctcaagcaactctcccaccttggcctcccaaagcgctgggattacaggtgtgagctactgcaccaggcccatatgcctttttaaaaaaattatcttttccattggtgactatgaggttgagagatgattctcctacatttctggctgctcctcttcaagtaccttccctggctcctctggatttttttgttttgttttgttttgttttgttttgtttttgagacaaagtcttgctttgttgcccaggctggagtgcagtggcaggatcttggctcaccagctcactgcaacctccacctcccaggttcaagggattctggtgcctcagcctccagagtagctgggactacaggcccagctaatttttgtacttttggtagagatgggggtttcaccaggctggtcttgaactcctgcctcaggtgatctgcccacctcggcctcccaaagtgctgggattctaggcatgagccaccgcgcctggcctggctcctcttcttcttccactcagatatgcctgaccctgtcaacactttggttgaggtcttctttcttctttcttttttgctccgcacatttagcttatgacttcaaccatcatttctcagagcatgggtctggctcaacctctctcctgaatttcagacctacaagtctagctacttggtggagacctccccagaatgacctgctgcttcccaaaagcagactctccaaattacagtcagtatctcccccggaagcattcccccaggcatttctctttctgccttcaattccccattctcctacattgccttgccagaagcctgctggtcagcttggatttctttttgtccttttttttctatattttgctggtgcctagtcatgtagttgctgcctctacactttctcttctttaaaaaaaattattaaagcaccacgtgcttgttgtaaacatttccagaaaatacagaagtgctcaaagtgaaaaaatggaaatgccttgtcccttcctcattccctgccctaacctcacgccccagattcagctatgtaatagtctgtcatgccaagtcttatttccagctcctcttttccatccccactgccatcatctgaactaaacggattgttttccatctggtctccttggcttttcctttcagtgcagctcaacagacattaatcaagtgccttccacacaccaaagtcctaccctagatcctagaggttcagagacaagtaagatagttaaagagatccacattccagagctgtttaactttgggcaagttacttaatctctctgacccttacttccttatctgtaaaatgatgctaatcccagcacctttttcatgggtttggacgagcattaatgagatgatccatgtaaaactctttgtactaactacctggtacactgtatctgctccataaatgtcagtgacaacaatgataataatgacaatgtttggaggagtttatagcttaatggagagacttaaagcataagaattatctaggcgaagaatgatgagaaaatatttttggaaaaggaaaacaaacagttctactaaaattaaaaggctgatgtagagacttgggaaactgggaggtaagagctcggactgtgtcctctaagacagtaattcccgaagtgtgagcaaaagtccacctgcatcagtcttacttggggtgattgctcaaaatgaggatttaatggctgcacctccgagcaagttggtaatttacatatcggaatgctatccatcaaggaaaatgggcagactacagttacatgcatcaacacagacaagcttcaaacaatattgagtgtaaaaagcaagacatagaaatatatatttagtaagagtaaaaatacagtaaaggtaaaaaagaggcaaaactaaacaatatattgcttaagcaataaggatacacaaactaatgaaaatcaaaggatttactaatacaaacttcagtatagtaattaattggaatgggagagaaagatgcaaagtttctatttctttttttgttttgttttgagacagtgtctcattctgttgccaaggcaggagtgcagtggcaggatctcagatcactgcaagctcagcctcctgggttcaagtggttcttctgcctcagcctcccaagtagctgggattacaagcatgcaccaccacacccagctaatttttgtaattttagtagagatggagtttcaccatgttggccaggctggtctcgaactcctggtcttaagtaatccgcccacctctgccatcaaagtttctgtttcttaagttggctgccgagtacacaggttttctttgtaaaataattatttaaattgttaatatgcattacttatatgcttttcatttacaatgtatttcacaagaaaaataaaacaaagcaaataagaaaacagaacacttctccagagattgatctttttcactcaaatctcattgagttatactgagggggaaaaagagtaatctgagtgcctgggccctgaacagacacactagatcagttccttcattcccactcaaacacatgcacacacacgcacaaacacacattttcttatatttccttcagcaaaccccccgccccaccaaccaaccccaaaacaccctctgctcctttatgtatataaattagagcagataaatgtccagaagattataggccatctttctataaacagccaatcttggacctggtgtctgaatgggggatgccctgctgcattaaagatgctcatgtgaacattttgttgtttcccagaaaaaaagtttccacattttagattattttcacagggtgagaacaattttacacctcccttacttgctgcagaatcttttttttttttttttttttttttttgagacaggtcttgctctatcactcaagctggagtgcagtggcacgatctcggctcactgcaacctccgcctcccaggttcaagcaattcttctgcctcagcctctcgagtagctgggattacaggtgcgcaccaccatgcccagctaattttttgtatttttagtagagatggggtttcaccatgatggccaagctggtttcaaactcctgaccacaagtgatccgcccacttcggcctcccaaagggctaggattacaggtgtgagccaccacgcctggctgctgtggaatcatttttaaagtgattgtatcaatttacagtgttccgaacagtaaatggctactagtctcatcacaccctcatctttaaaaaagttttgctaatttaatagacatgattcttacatattgtcttaatttgcatttctttgcttaccagtgaggttgaacatttttttctatgttagaatctttcttgtatttcttctgttgttttcattagagtaactcagagcaggattgggaatctgaaaacatgaacatttgattttgaggaagtcattgttttcctgttgtcttccttccccctctctgctttattattttttacttcaggttcatttatagaaatatcagaaaatacaattaagcaaacagagtaaattccacttcccagagataaccactaccgtttgttgtatatccttttaagctttttctctgccaaaaatattcacaaatatatcgcttattctttctgagcctgtttcctcatctatcaaatggaatacttgttcttcaagttgataattaactggtgggagcacatgaaagtattttataaagtgcacaaatgcaagttgctgctcttatgacaaagaaaaaatgtattttattctgccaagcagaatgatgacactttgtttcctgaacacagcctgctctctccagtacaatttcttctctctagaatagcttcttgcttcaattcctcctgctgaactactatctactctttttttaaaaaaatcaatattaaaatatacaaaaattagtgtaaagagcaaccacgtacccactatacagcttaggaaaagagtctggcatttctcactcctatgcctttatatatacttgctttatttcctgtctctctatatatacatacatatatatttagtaagagcaaaaatacagtaaagatcagggaaggtgcggtggctcacgcctgtaatcccagcactttgggaggccgaggcgggcagatcacgaggtcaggagtttgagatcagcttgaccaacatggtgaaaccatgtctctactaaaaatacaaaaattagccaggcgtggtggctcatgcgtgtagtcccagctattcaggaggctgaagcagaaaaatcccctgaacctgggaggtggaggttgccgtgagccaagattgtgccactcactccagcctgggcgacagagtgagactccatctcggggaaaaaaaaaaatacagtaaaggtaaaaaacaggcaaaactaaatatattgcttaagcaataatgatactcatacaaactaatgaaaatcaaaggatttactaatacaaatttatagtagttaattggaagcatatgtattatataaatatacatgtattatacatatatgtatatatgtatatatatagaaaaaagcaaatatatgtatatatacatatatatctatatatgtaaaatttttatttataaaatgtttttgagcatgaaatgatatatcattgtggtgttaatatgcatcttagctgggcatagtaggtcacacctgtaatcccaacattttgggaggctgaggcaggaggatttcttgagctcaggagttcaagaccagcctggacagcatagtgagaccccatctctaaaaaaaaaaataaaaattatctggcgtggtggctgatgtctgtagttccagctactcaggaggctgaggtgggaggatcacctgagcactggaggtcaaggctgcagtgagctatgatcatgccactgcactccagcctggatgacagagccagatcctgtttcaaataaataaattaaattaagttaaaaagtatctccctgattagtggggaagttacccaactttttttttttttttttagacagagtctcagtctgtctcccaggctggcatgcagtggcacgatcttgtctcaccgcaacctccacctcctgggttcaagcaattctcctgcctcagtctcccgagtagctaggattacaggcatgtgccaccatacccggctaattttttgtatttagtcgagatggggtttcgccatgttgggcagactggtctcgaactcccgacctcaggtgatcctcccacctgggcctcccaaagtactgggattacaggcgtgtgccaccgtgcccagcagttacacaacttttacaagtttattgttgttcatgttgcctcttcagggaattttgtttataaagtacctattcttcaaggccccattaaaacacctccctctccataaagtatttccagatctcctctatcaagcagataggatttcctttggacttctataatcctttctttctacatcttgggtttcactcacttcttatttcatcttgcattacagtcacttgtgtacttgtctaaagggcagtgactatgtttaactcaactttatgcccttgttcatactagtacaaaagtaaacatttcataaatctttgttgaatcaaatcctactcctcccctgcttataaaatcttaaatcatttcctattgtctacagacgaaagtagaatctcgtttaatgtagaatttaagacccttccacgggctctagcatcaaccttcctttcttgctcttctcctgggaggaccttgctttccgccccagatactagattcttcatccacagtaaggtcccagtccactaatgtttggcttttctctctgtagctgggatggcaggttggtcccacccattttagttgcctataaaattcttttttttttttttttgagatggagtcttgctctgttgcccaggctggtatgcagtggcatgatcttggctcactgcaacctccgcctcctgtattcaggcaattctcctgcctcagcctcccgagtagctgggattataggcaactgccaccatgcccggctaatttttgtatttttagaagagacggggtttcaccatgttggccaggctggtctcgaactcctgacctcagatgatccgccctcctcggcctcccaaagtgctgggattacaggcgtgagccaccgcgcccggtctgagccaccgcgcccggtctgagccaccacacccggtctaatttttgtatttttagtagaggtggggtttcaccattttggccaggctggttttgaactcctgacctcgtgatctgcccgcctcggcctcccaaagtgctgggattacaggcttgagccactgcgtccagcccaaactctttaagagaaaatctcttgggatcttgaagccagaagcttgcttttattactgagtttgccctgaatctgtcacttatgtactaaaaatacataaatttccttatccaggtgacttgggctcaactgaaggaaacctgaagcatctaaatgttagcacctaagcctgagtctaggtgccagcatagcctgtcttccctctccagagtcagaggcatgttacaaacagaatatatggacacacgtcgaaccccacattgtatctctctaatttattcaatttaattcagtaaacactcattacctcttatatccaggcctagttgagggtgctggggatacaggtataaacatgacagttctcttgaggagcacagagtggttgtgggaaacagacatacagacacacagtttctttctttcttttttctttttttttttttttttgagacagagtctcactctgtccttcaggccggaatgcagtgaggtgatctcagctcaccacaacctccacctcctgggttcaagcgattctcctgcctctgactccccagtagctgggattacagtaatgcgccaccacacccacctaatttttgtatttttagtagagacaggcttttgccatgttggccaggctggtctcaaactcctgaactcaggtgatccgcctgcctcggcctcccaaagtgctgggattacaggtgtgagccaccatgcccggcccagacacatagtttcaatacaagaagtatatgtcagccagagaagggctatcttgagagtcaaggaaggctccctggaggaggtatcacttatgccagttggtacatgaatgagtaaatgcaaacaagccatgatactgaaataaagctttgtttaattaaccttcacatgtaaattcagccacagaagacattctgatacatgggggcattgccagtgattccacgaaactggataatgtcattgatgcttgtggttgagagagcttgtttctgtattgtaaggaaggtggtacaacctggcctttcttttaaaaaaaaaaaaaaattcaaactggacatgtgtcaatgaactgactggagtcttagggaggaacattgctccatagctatatgtctctcccgttttttcctgtgttagtctttttttttaatttttttaaaatttttttgagacagagtcttgctctgttgcccaggctggagtgcagtggtgtgatcttggctcgctgcaagctccgcctcccgggttcaagcaattctcctgcctcagcttcccaaatagctgggactacagatgcatgccaccatgcctggctaatttttgtatttttagtagagacagaatttcaccatgttggctacactggtttggacctcctgacctgaggggttccacctgcctcggcctctcaaagtgctgagattacaggagtgagccaccttgtctagctctttttttttttttcttttgagacaagttcttgctctgtctcccaggctggaacgcagtggtgcaatcacagctccctgcagcctcgacctccccagctcaagtgatcttcccacctcagcctccccagtagctggggccacaggcatgcaccactacgcccagctaattttttttattttttgtagagatggtgtctcaccatgttgcacaggctggtatccaactgctgggctcaagcaatcttcctgccatggcctcccaaagtgctaggattacaggcgtgagccactgtgcccacgtgttagtctttacataactgaatagtgactgaagtcttgcagtttctaccttgccctgcactggcattataagttgtagtagaaatgtcactcattgcttgtaatctcatgagaggcctagttagatttttctgtactctacttccagaggagcttataggaaggtgactttccataaaggatgtgagctttctaccacccaaatatcagtcgtaaagaaaatgaggagtgataaagaaagaaggtattgagaggtgaagccagctgggcttctaggttgggtggggacttggaaaacttttctgtctagctagaggattaaaaacgcaccaatcagcactctttgtctagctaaagtattgtaaatgcaccaatcagcacactgtaaaaacgcaccaatcagcactctgtgtctagctaaaggactgtaaacgcaccagtcagcactctgtaaaatggactaatcagcaggatgtgggtggggccaaataaggcaataaaagctggccagcgaagccagcagcaggcaacccactcgggtgcccttccatgctgtggaagctttgttctttcgctcttcacagtaaatcttgctgctgctcactctgggtccgcactaccttcatgagctgtaacactcaatgcgagggtctgcggctgcattcctgaagtcagcaagaccacaaacccaccgggaggaacaaacaactccagatgagccacctttaagagctgtaacactcactgcgaaggtgtgcggcttcactcctgaagtcagtgagaccacgaacccactggaaggaagaaactccggacacatctgaacatctgaaggaacaaactccggacacaccatctttaagagctgtaacgctcaccgtgaaggtccgtggtttcattcttgaagtcagcgagaccaagcatccaccaaaaggaataaattccagacgcagtatttacagcccagtgtccacccattccccatgtagcaacccctggtacctgaggaaaaaggtcacagcctctgccaatggtggggcatctttccgaagaggttccacttggactttttgaaacatcatgtggctgtgctgtttgagaagcctggggtgaaattaactatacaagaatcagggcatgatcacacacgcacacacctttgcaatttttctggctttgtttacactgttactgcaacttgtgccctttctcacccttttcataggtcttccctgcaaagtctttttttttttttttttttgagacggagtctcgctctgtcgttcaggctggagtgcagtggcgtgatctcggctcactgcaacctccgcctcctgggttcacgccattctcccgcctcagcctcccgagtagctgggactacaggcacctgctacctggcgcagctaatttgtgtatttttaatagagacgggtttcaccgtgttaacgaggatggtctccatctcttgacctcatgatctgcccgcctcagcctcccaaagtgttaggattacaggcctgagccaccgcacccgacccatcaactgttctcttatctgtgctcctagatctctatcttgatgtctgaaagcttcttgagagtgctttgtcaggtctatgtccatcacattctttggtggatgtggcctcacaaatctttcaactcagccctctaggtcctcatgtgcattagtggagaatagcgttcacatatgtgggctttgggtccaatgcagtttgaatcctgagtatgtcactaactagttgtgtaatttttggaacattgttaacctttctgatttcagtttccttatccttaaattgaaaattctagtagttcctacctcataggattgttgtgaaggtcaaatgagatcaaatacttacaactggacctaaggggcactcattatgagttagctgttgttactagtaacccattgtcatccctgtagatgtttcaggggtttgccgtggggaaccctgccatgcaggcttgtctcaggttctgaccctgtgatggggtctggtgttccctgcctcgtttaccactctttccccatactttggtctgactctccaatgagctcatgattcctatgagcgatttctgtctcttgatgaatctttagatttgtcctttgtcttaggccttgagactgcagtagaaccttgtggcctattctaaccccagcccggaaaccaatgccccaactccattctgggctgacttcctggcttcctcccacaacttccgggtctctgtttttatatattgttcctagactaggatatgggtgttcacaaatgtttgttgaaaggttttcagaggcaattaggcatatttaagaagtgaatgaacacctgctcattgatatgctgtccataaactaggacacggtgttgaatgatgatttgacagagattttagaatcagagagatggaagcttgatcctaactctgaatcttatggccttaagcaaaatatctaacctctttgtgcctgttttctcatttgtaaaatgaggataattatatttcctcatagggttattgtgaagattaaatgagacaatataaataaagcacctagcattttctggaacatggtaagcagttggtaaatagctgcaactaccaacaggtagttcaaaacttttcctccatctgaaaaaccaagagttgaagaaatggctgaagttggaatatctggcaggagctgtgcttaaacacaagatccggaatatctgaatatctttaggacaagatgaaataggtttctctcaaatgagttggttaaggagttaagcagtgataggtaacacttgaagtttcacaaagatgaaaactggtacttgacagacagccacttgatggtattctgaagtttactgaccctttgttctatttctagaacaaggtgttctatctctttgcccaaggtgttcaaagtatagagaaacaaagaagatcagtaattacatagaccaaatggagtatcggatttattacgaactacatctgctcaaaagactcatgaactatatggagttagtcctatcagagagaagcagggtatccagctagctcataggcctttttatacaaaagtttaccattagcatgtttggtaacattacttataagccaccccaaccccctccccacacactcaagtttccttaagtgtatgtattagttttctattgaagtacaggcaagcttgactgggttctttgctcagagtcttacaaggtcaagattaaaatatccactagattaaggacttatcttgagactgtgaggagaatctgcttccaagctcatttaggctataggtagaatcaagttccttgcagttataggtctgaggtccctgtttccttgctgactatcagtcaggggccactcttagcttctcgaggctgctctcaagtcctttccatgtggacccctccatattcaataccagcaatggcccattgaaccatcccatgctttgagtctctgacttcttttgccagctaaaggaatctctctacttataaatggctcatgtgatgaccaggataatttccccatcttaagatcaactgtttagtgccttaattgcatctgcaaaatcccttcaaaatagtgcctagattagtgtttgattgaatagccaaggattgggaatcttgggcagtcatctcagaattctgcctacacagcatggttacaatttcctgaaaagctatcctgtgaggcctgacagttatagtacaagcattggataaacattcccatttcagaatggagaaatcagccaacaagaaaggtgctacaggccccatgcaagtttgaaagctggaagggcagtcattagatcttaaagctctaacataatctttgactccatgtcccatatgctgggcataccggtgcagtgggtgggctcccaaggcatggagcagctctgtccctgtggctttgcaggattcatcacccatgactgctctcatgggctcgagttgagtgcctgtggctttgccaggcacagggtgcaagctgctgttggatctaccattcttggatctggaggatggtggccctcttctcacagctccactaggcagtgtgccccattgggaactctgtgtggggaatgtgtattaatctgttctcacactgctaataaagacatacccgagactgggtaatttataaaggaaaggggtttaattgactcacagttccaccgtggggtggggctcacaaccatggcagaaggcaaatgaggggcaaagtcaaatcttatatggcagcagacaagagagcttgtgcagtgcaactcccatttataaaaccatcagatctcagggaacttattcactaccactagaatagtatgagggaaaccactgccacgatttaattatctccacctggccccacctttgacacgtggagattgttacaaatcaaggtgagatttgtgtggggacacagccaaaccatatcagtgtgccaaccttacaattccccttggcattgacctagtagaggttctctgtgaaggctccacccctgcagcagtcttctgcctggacacccagacttgtccatacatcctctgaaatcaaggtggagggtggcaaacctcaagtcttgtgctctgtacaccgcaggcttaacactacatggaagccaccaaggcttttggcttccaccatctggaactgcagcccaagctgtacttgggcccctttgagctgtgggtagaggtggagcagcctggatgtgggaagaagtgtcccaaggctgtgcagggcagcagggccctgggcttggtccaggaaaccattcttccctcctaggccactgggcatataatgggagaggctgccatgaaggtctctaaaatgcctttgaggtctttttcccattgtctttggaattagttcttgggtcctttttagtcaagcaaatttgtctagcaaatggtggctctccacagcctgcttgaattcctctcctgaaaaagctttttctttctttgccacatagccaggctgcaaatttttcaaacttttatgctgtgcttcctgtttaaatataaattccaactttaagtcatttctttgctcccacatttaagttaggctgtcagaagcagccatgccacaacttcaatgctttgctgctgagaaatttcttctgctggccaggcgtggtggcttatgcctgtaatcccagcactttgggaggctgaggtgggcggatcacctgaggtcaggagttcgagaccagcctggtcaacatggtgaaatctcatctctattaaaaatacaaaaattagctgggcatggtggtgggtgcctgtaatccctgctactcaggaggctgaggcatgagaattgcttgaacccgggaggcagaggttgcagtgagccaagatgcaccactgcactccagcctgggtgacagagcgagactcagtctcaaaaaaaaaaaaaaaaaattcttctgtcagacacttagatcatcaccctttagttaaaagttccacagatccctagggcgtggacagaacacagccaagctctttgctaagacacaacaaatgtgacctttgttttagttctcaagaagtttctcacttccatctgagaccttgtcagcctggccttcattgtccatatcactatcagcattttggttgaaactatttaaccagtctctaagaagttccaaactttccctcaccttcctatcttcttctgagccctccaaactcttccaacctatacttgttacccagttg

SEQ ID NO: 1569 - DNA, 7573 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtacgtaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgttc

SEQ ID NO: 1570 - DNA, 4974 bp, Homo sapiens
atgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaa

SEQ ID NO: 1571 - DNA, 25424 bp, Mus musculus
gatccttcaatcgccacctgcctccctcccctgtagtgtgggagttacaggcaagcatggccatgccccactttttacgaatgctggggatttgaacccaggtcctcatgcttgcacagaaaatgctcttacctactgagccatctccataatcacctcaattttcttttcttttaaaaatatttttattttatttttgttgggtgttttgtctaagtatatgcctgtgttcccacagaggccagcagagggcatcatagcctctggaactgacattatggacaattatgagctaccaagtgggcactaggaatcaaacctaggtccttaggaagaggaccttggaagagctcttaactcccgagccatctctggagtcccccacttaactgtgaacagcagttctgcaaatcaaaccaagacctcacccatactaggcgagcactccagtccttagctgtatctctcacccacttatgacctttcatgctacacaagtattttcattttatatatttttatttttcttatttgtttggcttagtagacgtgttatcacacctggtcatgatctgtttctaccccactcccgtttttcatgcatgtgctgtggtatgcatgtgtgtatacatgtatatatgcatgtgtatatacatgtatgtatgcatgttcatatacatgtgtgtatgcatgtgtgcatacatgtgtatgcatgtgtgtatgatgtgtgtatacatgtgtgtatgcatgtgcgtatacatgtgcgcatacatgtgtgcatgcatgtgtgtatacatgtgtgtatgcatatgtgcatacatgtttgtatacatgtgtgtatgcatgtgtgtatacatgtgtgtatacacgtgtgtatgcatgtgtgtatgcatgtgtgtatgcatgtgtgtatgcatgtgtgtatgcatgtgtgtatgcatgtgtgtatacatgtgtgtatgcatgtgtgtatgcatgtgtgtatacatgacttttcctgtgtgagagtgcacttgtgtgtggatatacatgcatgtgtggaccagagcacgtggagggccgaggctgatgttgagaattaccttccattgctttcccactttatccagggtctctcaatcaaacccagagctcactgatatgactaatcttactaaggagcttcctctggagagtgagctcccatctccactttccaaggctgacataggaggcaggccatcatgcatacctggcatttactcgtttctgggcatccaaactctagcgctcacgcttgtaaagcaagtgcttaacctgagccatcatgcgatctgctctaattttttaagacaggtcttgctttgtattccttgctagcctggaactctgtgtagcccacactggccttgaacacttgcccttttttaaaatttatttttattattttatgtgtatgattattttgcttgcctgcatgtgagagcactgtgtgtgtgcctggtacccgctgagttcaaaatgtccttgtatgccctgagactggagttacagacaagtactcttaactttggagtcacctctccagcccttcttttgtgttttgataaatgaggttaattagtgaagaaatggtgcattcaaactgttacagtttcttctaggctccacaccatggttacctggcaacagctaggtatgcctgactcactatagaagggactgcttgcctgtcttctcttactctttttttttttttttttttttttttttgagacagggtttctctgtatagctctggctgtcctggaactcactttgtagaccaggttcgcctcgaactcaaaaatccgtttgcctctgccttctgagtgctgggaataaaggtgtgcgccaccacgcgcccggcttctctcttactcttttactctctaactctcctccctttctgccccttctctccccattcccctccccacatctctccacgggttaatggtcagcctctctctctctctctctctctctctctctctctctctctctctctctctctgcctttctctgcctctattaccccctaactcccctccccatgccctaaatgaactctagtttatactatacctcgtcctgtgcctgagcatgggcccacagaggcaccccctcacctcatcataccacaccacctccaaacatatccttggcctttctttcttttttataaaacagaaaacaaacgtttttgggggtgatgtggaaatccaattcagaatctataaaaagacaggatgaacgaaattgactggataaaaattcagatttggggctggagaggtggctcggtgattaagagcacacacttactcttgcagaggagcaaagtttgactcttagcactcacgttgggcagttaataaccttctctaattccagttccagaggatccaatacctctggcctctgtgggcatccaaattcaaatgcaaatacccacacagaaacacataattaaaaataaaataaaccgtgatggagagagagctcagcagttaagagcactgactgctcttccagaggtcctgagttcaagtcccagcaaccacatggtggcttacaaccatctttaatgggatctgatgccctcttctggtgtgtctgaagacagctataatgtacttataaataaaatatataagtcttttcttaaaaaattaaaaaataaaatgaaccttaaaaaaaaaaccaaaacccagatgtggggctgaagagatggcttggtggttaagagcattggctgctctttcagaggaccctggtacaacctcccgcacccacatggtagttcacaacttttataactccagtcaggagatcctacaccctcaaaccagtgcacataaaataaaataaaataaaataaaataaaataaaaaatttaaagccaaatatcattttaagtcagaagaaatgaatttattttgctgtgtgtatgtttgtgtgtgtgtgtgtgtgcgcgcgtgcgcgcgcgtgcgagccagagttacagggaagttgtaaggcacccatacgggtgctgggatctgaaactcggaatcctttgaatgagcaggaagtgctatttaccagtaaactatctctccaacattcaaattctttcatttgatagactacgagaaagcaaacgacaaaatgagaaaacaacagttcctgggtcagcgagatggctcagtgggtaaaggtgcattttatcgtagaccacggaggatattgtttatcacttctcccttagatttcctacctgagtgtccaggtagttactctcttgtttttatttagtatggatcccatggaaccaggcccacaaactgttgtgagctgtaatgtaggtgttggggtcttctgcaagagcagcaagtgctcttaactcttacgcgcgctcaactggccaggaagaacgacgctgcaacaggatccttctgcacacgtttattgggagagcttgattgtagaggcgaaaagaccctgagcccagaactggtgctgcttacataggcctaggagaggtgtgtctcacatctgattggttaacttgtcttggcaaaagaaccttcactgcctatgtatgtgtagtggccagcagtagccaactgccactctgcaactgccactctgcaactgccactctgcaacggcttcccacacttaaccactgaaccatctctccagcccccaagtcaagggttttaactagagcgagtaagggagtaaaagtttgtatgctctttgggaagagagcaatccgtacagagtaggaatggctgtgtcggggacagaagtgggtttagatttatcctttatctgttatcctctccctgtccctccattaaggcgggcactaaaacaaagtggcacacttttcttggaagctcatttcacccagtcttggggcttaagtgccctcaaagctgaaaagttcacttggtgaaggggtagcaggcactccatgcatactcttatctagagataccctgaagccagttgaagctgagccaactagtagaccactaccatctattgctgttctttacatcctgttttggggaccttgagatgacccatctggaaggaccactattgtcctttgtgtcctgttttagggtgcctgggtggtcattccctcccagagctaacctcttgcctaactgtagggcaggttccaaggagccgactatagactaggacttacaaagcagaaagagcggggcggggctttcgtgaagacgcaagaataccacgtgtgaaaacaaaggggagtgcaaccccggagtgcaaatgcctgtgcgtagctgcaaatttccaggagaggtgcgaacttgggccaagaggaactttgattgcgcagatttcttctctgcttagagtcagcttttggctctcgagggctcatttgccactcaattctcagctgaaaaagactgataaattcacccagctttcattttttatagataaatacacgcgagctttagagaattggcactatctgtctcaggtgaaagctttgggcagtactagaagacagacagctagtcctgggtcgtcctctgcctctgatccggaggcattacttacggctatcaaaccctctgttcgctcaggtacaaaccacccccccccccgtctctgggtaaactacatttcccgcaatgcatcgggtggaacttccctcccaacgcccatctggacgcagttttcaccaatagtggagcagaatttcaggaactgttgtggacagccaatgagagtggccatgggcgggcctctcccgtccattgttctctgtgccccttgggcttgagctgaggtgaatccagaggggccgggccgggccgggccagaccgtggggtgcttttgcgctcagagagatagcgggaacaggacctggtccctggagaggcgagcgggagaggcaggtcaggagccgcgcgccccgcggggaacagccagagagacagcgagtaacgggcctggagccagctcagggcagtttgggggaggggcgttcggtgtccgcgcccgacgggctggacgcgcagctctgcgtcctggttcttcggagccctcgaggctccgctcacaccagagcgctgggtacgcgcagcctaggaacgcaggctttacactgggaagggatgctcgacgacatcccaccgagccgcctccttgaccaggtggggaaactgaggttctgagggggcgtgtcggagccaggcttagctaataagctgtctaggttcagtgttcccgggatgtccaggaagaattacgatgtatttgtgtttcacgtagtcattttggacaaattgacattgggagcttcagttttctttctgttgttgctgttctgttttaacttttgctattttcatgggggagggcatgttatctgattctatggtgtaatgattttttaaaaataaatattcattgctttcataatacttatatagtttttaattccactgctttgaatattttgtagagctactactcagatctaggtgtgtgtcccccacacccccaccccccgcaatgatccccatgtgtgttcatttaaaaaggaattgggcaggcagtaatctcagcactcaggaagcaggacaggcaggtcaggagttcgaggccagcgtgggctacataatgagatcttgcttcagaagcaaaaaaataaacagaaatgtctgtactgaacatgtaggagcgttctcgttattattcccaaacagtacagcataccaactgtttacatattatttacacttaagtatatgttgtctagagatgattgaaggtatttggtacaccattttatataggggccttgaggagtcctggattctgggatctgggagattatctgagggcaacctcctttgaaatatagcactaatgacttgtagtgaagctgggggcaccttgacatgcgatccattagtaatcactatgatgttccatatgataaggatgagtgttatctattcattaagtggtcactgaggttgaatgactaacctctttgttaggtcacagtctctgaagggagtctgaactgacttagggtaggatatgtcagttctgtttctctcagcccagatcactgcatcccactactcttcctttggtcttctgaaaagagcaatgctgtgtatgtgtgtggtagttgttattattattattattattattattattattattattattattattattgggttgctatatccccttgttgtctttaaatatctactaggtgtttctaccccacttcagaccatattgttcccagataaaagacacagaaacctgtagattcataataagcttaaaagcattaaagttgggctattttgtctacctcccaaggtatcacttgccatgctctgcctgggccgcttctactccatcaggccagcccctatagccatgggctcatgaactacctcccccatggccacttccttctttctttttctctcttcatggtctctacctcagatcccaagcctgggaacctttgctccaccccctgccttctgcccagtcatctctattggctgggataagttggggggtggggcaaggtttacagagcatcatttggtgtatatgagaccttctagttgcgtgcaaccagatcttgggggccagtatttagcatttgaatagtgatatcagaccaatgttgtgtgtgtgtgatatttcttcttttttgggggggggggggtgggtgtttcaagacagggtttctctgtatagccctggctgtcctggaactcactttgtagaccaggctggccttgaactcagaaatccgcctgcctctgcctcccgagtgctgggattaaaggtgtgcgccaccacgatgggctgtcatattccttttgccatagagagtcactgcttttagaagtaaggcaacaagcctctgttggttttaaatatgcggaggctgctatgagatggctgtagcagtttccttagtgattctggttctctgccttgtttctcagcagtgtttcttgttgagattggaggaaagacggccttctcagagagcctgactggagacaggtgttaggcttgaagccttcgtgaccatccaggaagttggacaatggcagccgaagtgccagcagtgagcactcccctcagccctttggttcaggtacctcaagaagaagatgaacaggcagaggtcaccactatgatcctggaggatgacgcgtgggtgcaggaagcagtgctgcaggaggatggccctgagtctgagccctttccccagagtgctggaaaaggcagcccccaggaggaggacgcagccgagggaccccagggtgctcttgtccgatttcgggagctctgtcggcgctggctgaggccagaggtgcacactaaggagcagatgctaactgtgctgccaagagaaattcaggcctggctgcaagaacatcggcctgagagcagtgaggaggcagtggccctggtggaagacctgacccagacttttcggcacagtggtaagacagaaccacagagggagagggtgggagccttcggaggttggagtagtgtcagggttttgttgctgttggtggtgttggtggttgtggtgtgtgtgtgtgtgtgtgtgtgtgtgtgtgtgtgtacagagaatggtctttgaacagactaggagatggcgcttgtctcttatgctccctgcagcactcagcaagatcctagctcttttagatccctcaccaatgtgcagtggtagctccagaatttcagtctgaggactcggagggctattcttggagctccgtttgcatacgaaacacagctttcacttgtttattccagggattggaaagtttcctgagatgagagataaaggtcaatggtaaataaaatgcctgcctagcacgcacaggaggttatcggaagctatttttgtgtttgtgatttttaattttccttgctatagagaaaaagtgtttcttcctcctccccctcctcttcttcctcctcttcctccttctcttcttcctccccctcctcttctccttcttcttcttcttctcttctgtcttctgtcttctgtcttcttgatcatgtctcattatgtagctctggctggcctaaactcactgtgtagaccaggctgacgtcaaacccacagagatctgcctgcctgcctctgcctcaagaataagacattcttcccttaagggaaacagaaaatttctgttgttttgcaggtatgagaacaaaaaagacctccataacccaccctttggttccttcagttggttgtaatcattcaaatagttccagcaattggaataaaagcatgccacttttttcaaagtggtcattgtatgaaaccatgataaacaataagtaaattgtctgggctttctgtgatatgatgtcatcttatatcctttaaagagtaattggccaggctaggaagggcacacctattatcctagcacttagaacccaggctagtatctacttcagttcttcctttccctaggataacttcaggaccctaagatgtggctgctttgtgttgatgaagtacttcaggaatacagaagggcatgtagagaggacaggccagaccagagaaggcttcgtagaagacatggaccatgagtaggagcttgcagactgaagtagaaattggaaagtcacagggcgaggagacagctgtgactgctgagaggagctgtaggtagccaaggctctgaagtgggggagcagcagaggaaggaggtttcttcagattcagagccggtgaggcaggcttgtgttttcaggaagtggtgggagtttggggggagggaggatggaggtttgaatgaaacgccattggcctcagcaggctcttgatctagggcctgtggggcaggagaggaagctgagcttggcaacaggatgtaggtttgattaggggagagaggctagaggttggggagcagtcaggaagcagcctggccatggtgtgtgcagggacaagagtctggccgtgggacgatgggacgtgagagaaagaacagcgtcgtgggagtgctttcaccaagccctcagtctgccggaagatgagtggactattgtccttagaggaagagtgacccactctaagatcacgcagccagtatgaggcaaagccaagactcttgtccttaagcatgccattgcaggaggggtcctaatgatttctagcaaggtgctggaaggaggagatcccagcagggattggggcagagcctctgtactgtccactctggaggacttagtcgattagagagggagatcatgaggagggggtagttcagggcagaaggtgtgactgcagccaaggactgagagatatggagaagtctgtcctcagaagaaaggtctgggcttaggggactgactgaaactagcccctcgctgggcaccttatatggcacccacaccaagaatcttgtgagatgagtgggaccgtcactgggcagaggaagcgcaacagcttcacacagctgtcattcggtagagccaggattcaaactcgggtctgtttgcttcagcctgagtttataggcaggacgttttatttgaagtgaagtattttactttctttgactttgacagataacttccttaggggtgtgcttgagatcaagcctaggaagtgggtcatgtgaggaagggctgtgtcactgagcctcacctacagcccaggaacttaattaacctacctttgaattgggagcgtgtctcttcccagctggcctaaagctggtatagtcaaggataaacttgaacttaaaaatatttcttttacttagttttatgtgtgtgggtattttgcctgcatgcatgtatgtgcactgtgcatgtgcctggtgccctcagaaggaggcatcagatctcccagaactgtatttatggaccacactctgagctgacaaggaggtgctgggaatcgaaccttggtcctctgggagagcagccagtgtgccgagctgctaagccatttacagccccaccttgaacttttgatgggcccacttcaccggataggattgtagatgtgtgctggcgttcctagttcttgtggtgcagaggcaccaaacccagggctgcttgcctctttgacaagcagggtaccaacctaactacatctttagtcagtttgttttgagacacattgtatcctaaattggcctgggtcttctggtaatcctcctgtttcagccccctgaagtctgggactatgtgatatgctaccatatttgacttgattttatactttgtacaaagaagaagaggggaaagaaactctgtcatcccgtttcagatctcccttgcctgctgatggctgaggcgagtttatgatgaccttcagggtttccaagtcaccccagaggcttgggctgaggtgtgtttggtgattgttaccttagggcagtgccaggtcagtgctgtggctcagcaggggtctgaggtgaccacagccctcaccacagccttgcagtgccttcctttctcattggtcatctgagttggtggtgggttctccctagaggaatcaggaggctaccctgtgacttctgcctctaagattatctctgctggcctctgtttgataacacgttgtgcccttcttcctcatagctgctcacaggaatctatattttccttcattccttcttaaacatcgattacctgagagcagccggcctctattctgattgttaagataaaggccttagggtttgtttacacaggaaagggcatttcaaggcctggtgagtcattgggtaatatttgactgagaggcacctctgggtgtatgcacttagtgttctgtgactccaagtaaaaccatccctcccgtatagttacgtgtaaagttgagctctatttgtccatgagtcccgcagttgttttagctccatttcaagccctgaatcaggctttgggatttcctgactgaatttttgcagtagtctctgaactaatcttgtagtctctttgccagtcatcagactccttcacatcgcccagagcagtccacctgcagcctccacaggcttctccctccttctcccacaggacacttgctcgctctctctctctccctcgctctctctctctctctctctgtttttgttattttctggctttttgttttgagatgaggcctcattgttgtgtctagacgaggctggtctttttgttttgttttgggtttttgtttgtttggttggttggtttggggttgttttttttttgtttttgtttttgttttccctaaacagggttactttgtatagccctggctgtcctggaactcactctgtagatcaggctggcctcgaactcatcatcttcctgccttagtcttttgactcaatcttgtttttctatttatatactcttatatcttttaggaacttaacaaaagtcccaaaggccagggacctaatccactcctcctaatcctttctcagttcctgctaacagtgagcactcagtgagtattgttgggataaatgaaggacacttttgcatctacaggtcgagagacctctacttgggatttcctgactgaattgttgcagtggtctctgaagacaaggttggagttgaaaatctgggttacagagaattccctttggtgcagaggacagggaaaccgctcaagctgatgatgagctgggtctgagcgatggagaatgagactgggagactgaatagtcaaagctcagaataaaagatggaggagttggctcagcagctaagaatacgtactgcccatgcagagggcccaggtatggtttctagcacccagacaacaacttaaaaccatctgtggctccagttccagggggtctgatgccctcttttaaccttctgggaaacaggcatgcatgtggtgcacgtgcgggcaaatgcccataaaataacatctcaggatgacatcactgctcctgggagacagcctctcagtgacttagggtttgtatgagattcaccagtgtccttgtttgatggctgttttcagtccatgacagacctgttaaaagaccacttatacaaagcaatagctaacttctgtaatggttacagattattactgaggtaaaaaacagaatgcttgtgggtttgtttgttgtctgtctggtttttccccccataaatgctttggggaatgagattcaggttttctagaaaagtcctgtatttacagttatgagccctggctgttctcccagaggacctaggtttagtttccagcacctacatggcagttcacagctgtaattccacttccaggggatctgacactctcacatggacatacatgcacctcacatgtactcacacacacatacaaaacaccaatgcacatgaaatgcaaataaatttttaaaaattatttgtcttttggatggagagagtggttaaaagtacttaattgcttttattgaagacctagacttggttcccagcacccacatcaaggtagctcacaactgcttataactccaattctagtgatggggtgtagtggcacacgtctgaaatcttagcattcaggaagtggagcaggacagttgtaagttagagaccagcctgaactccataagaagttacggtccctagtgggaggaaactcaatggctgtgcatttgcctggcacacttgagcaaatcctaacacctggccctctcccaaattgtccaaatattttccattccaatagttggcagttaaactatccagtgtgcttcataactgaagttagatgtcatttctcatggccctaatatttaagttccaataattcttggtataaaatgggaacaggttgcctctgtactgacctttagggaagtgaacccaggccccaggcaaccccaggccagtgaagtagcttcatcagggtggacgtgaaccctctctctctctttttttgtttgttttcttgagaaagggtttctttgtgtaacagccccggctgtcttagaacttgctttgtagaccaagctggcctggaactcaagagattcacctgcctctgcctcctgagtactgggcttaaaggcatatatcatcaggcctggcttgagctaaccctccttgatagatacattgaccacatggaattccatcatcccaatgcatggtagatatcaaagggaaggaaaggggaattattagtctcaaaattgataaattcctgataatagtcacacctggtagcacacacctataatctctgtgctgctgaggttgaggcaggaggatcatgaattcaaggtcagagtgggctacatagtgagttccaggcaaagtcttcaaccattactacagggtttgtccccctggaccagcagcatcagaattgttaaaaatgtgaatcccactccagagccaatgagtgagaaactttaagggtgggatcagctctttagggtcttacaagccttataggtgatcttagcttaagctctagtctcctaaccactacaccaggtctctggtttttaaagttggcaggtgttgaaattacctggggacctagagtccatgccaggggtgcttgctagagactggacccactgatttccatacgctaagcatatgctctattgaatgacaccgtagtccccatgcaaaggtttttggaggctccataggtagttctgtaatgcagttgtgtggcaatgtagcttttttactcaaaggatggtccttggaacacaatatcagcaggaagctgaggagaaatacacactattaatcttaccccaggcccactgaagcaaaatacacatttaattagatctctgggtggctcttctgcaccttgaagaatgagaagcctatgctgggttagagaggaacaggggtgttacattcatacctgttcttgtcccacagatgagccaaagaatcacagcttcaccctcactcaccacacttcacatattccatagtgcgcatgtggaaagctttcgggagctgtttctctttctactatgtgggtgggttctgggcaacaaaatttggtcatcaggtttggtagaaggcctctacctgctgagtcatcttagtgttcttcttccttctttaaggagagggttgtgtgtagctgaggtcttgaaattctatgtctatagccaaggataaccttgggttcctgatcttttgcctccctcttgagtgctggtctttcaggcatgagccaccgtgccaggttgatagggttctagagattaaacccagagctttgtgcatactaggtaagcattctaccccactatgctacctggccagatcatattcattatttatttatttatttatttcatgtatgttgtatactgtcactgaagagggcattggatccccattgcagatggttgcgagccaccatgtagttgctgggaattgaactctgaacctctagaagagcagtcagccctcctaactgctgagccatctctcccgccctcatattcattttgttaacatgagaggtagcactgttggacaggtagactgtgttaaaactccactttttatgtttaaagaggtgggtcagctgttaagagggcctgaatttggttcagcaccactatcaggtggctcccaaatgtctgtgcctccgattccaagagaatcctgagcctccaggcttctagggtacctgcactcacattcccacacaatatacataattaaaaattataaaattataacaagataaaaaacttcaggtcttagcttgaaatcaaaagcacattcattcagtcaaatctttgaatatataccacatagagctcttaagcagaactcaccctacactgtaaaatggacagtagtcatgaaactgataactgaattcattgctgttttccagcagctgggactgaggcagagcatcaatcgctcctggtcgctgcagcccatgtaggttccttccaccttgcctggatggctttgagtggtgggcgggctcctgtgagaatggagaggacctggtgtgggcatcagaccagtatcctgatcactgttttagcccagtggctggaaccacagtgttgagacacagttgtgtgtcatagacaattggcaggactgagccaactcaagcttctgtctataagtaaactatagtaaccatccctgactacaggtgattacatctaagacacactccactctaaacaccctccgtgtagcacttcccacatacattcacaaccatgataatgtttaatttatgaattatacattataataactataagagattgacagtaaaggctacagtagaaaaattataacaatatgttatactgcaaacttatttaacctggcaaatacctttattccaacactggggaggcagaggcaggcagacctctgtgagttcaaggccaccctggtctacataatgagttccaggatagccagggctatgtagaaaaaaaaaattagaatctgtgagttctggaattttttttgttattttgttttttttttttttgtttttttgttttttcgagacagggtttctctgtatagccctggctgtcctggagctcactttgtagaccaggctggcctcgaactcagaaatctgcctgcctctgcctcctgagtgctgggattaaaggcgtgtgccaccacgcccggctgagttctggaacttttatgtactgttttttgcactttagttgactcagggtaactgaaactttaggaacggaagcaggagataggggggactattccaaagcacattggtttatcttcatctttaacatcagtttccttcgctcatcctgaaatgctttttgttgtaggagagaaagggcccacagctaggctggaaatgcacaggtcctcaggagagccataggaccatgctgtacacctgagcctaaagaatgtgttaagggggtggctggcgagatggctcagtgggtaagagcactgactgctcttcaaccacatgatggctcacaaccacccataatggcatctgacaccctcttctggtgcgtctgaagacagctacagtgtacctatttataataataaataaatctttgggctggagcaaacagggactgagcaagcagggccaaccggagtgaacgggactgaccaggagcaagcagaggtcctaaaattcaattcccaacaaccacatgaaggctcacaccgcatgaagctcacaaccatctgtacataagtaaattaattaataactgttagctcttaagtgtaacagttcaactgctgagtggacagtttttggatagttttgagaaaaactaaaattgaggccagatattgtggcatactcccttaatcccaacactccagagacagaggcacatagatctctgagttcaggtccagactggtctccatcgagttccgggacagcctggtctacagagtgagttccaggacagccagggctacacagagaaatcctgctccgttaattattaatgtgactatatatgtatctatgtatacatacacacatatacttatatgcacatatatttatatgtaggaaaataatgtcagcacagtttatctttaaccagccagttccccaacgacaccaagagactatgatctactgacttttttttctttttttcctttctctttctctctttcctttttttttttgtttgtttttgtttttttttttttgtttttttgagtcagggtttctctgtgtagccctgactgtcctggaactcactttgtagaccaggctggcctcgaactcagaaatccccctgcctctgcctcccaaatgctgggattaaaggcgtgcgccaccactgcccggcctatgcacagcttaaaagcacagtattgagcagccattcctataaggtagtctggatgtcttcctgccaaagtccccacaacccttgcatttgggcgttctcgctccagcagagcccttggtacctcttggacccctcctgtggttggtcttctacttcctctttccttcccctcccctagctgggatcaggactctccctccacccagcactgctggccagcgtttattgacaaggcagagaactaatgctgagcactgtttatacaaacaggaggccggagtttcccaacacaagcattacaatgctgccctgtccccattgaaatgaagtagtgaggtagaaaaaccagcatttggataacaagcgtaaactttacacagtgtacaaaatcatgctgtcaggattgctcagaaaaacaaaaacaaaacgacaataacaacaaagggcaggcatgtgtatgtaaatacaattccagccctgaggaaggagccctggggcttgctggccagccagcctagcctagttggacagacctaggccaatgagaaatgggatctcaaatggtgcctaaggaagagctgcaccagtttgcttgccctcttgattccacatcacacaatgttcttggtctgaactcttggctctgtgattctaatcaagcaaggtagaaagggctgcagaaatgactagggggttaagagcactttctgttcttcccagaggactcaagttgagtacccatgaccacctgtaagttcaactccagtggatccgatgccctcttcaggccactgagggcatctacacaagtgtgatatacacacagcagagtaaaaatagacacatttttatatacccctgaatatcaggaacagagactaagaggctcacaaggttgggtttgcttggtgttgaggtcaggaagaaaacgccctctgcaggctcatagcaggcaacatgtggcataaacagcattgtagactgcttcctggcaacatccatgttcctgacagtcattagttcctaaggtatgtatttctttgggtgtacgtagtgtctgtaggccattacagcagcacatggttcagtaaacagtctcacagggcacagtgtagtccaggtttgtggttgttcctcatcaagcttcatactcattttatgtgtatggctgttttgtctgtatgagtatctgtaccaagtgtgtgcctactgccacagaggccagcataggtatcatctgagtttcaggaagttaggagccactgtgtgggtgctgggaatcgaaaatttaaaagaaaaccccataacatctgtgccccacacacatgtcttacccacagaagcgtaagagggtatcatgttcccagcactggagatacagttgctagtcaccatgggattgctgggaattgaaccacagaccattgaaagagcagccagtgttcttaaccactgaaccatccagcccaatatccatctttttttttttttttttgagacaggacctcagtggcttggagcttgccatgtgggatagtctggctggccagtaactcctagggatctgcccgtctctccttcctcagcactgaccttacaagcacacacctccacagctaggttttatgtgggttctgggagtcaaggccaggtcctggtgctgccaaggaagtacattaccaactaagccatctcccagtcctcttcattttcatttaaagatgtgtgtgtgtgtgtgtgtgtgtgtgtgtgtgtgtgtgtgagagagagagagagagagagagagcgcacatgtgtggagagcagaggacaacttgctggagctggttctctcaggctatcaggcttggtggcaagcaccccccatccatgctttatctttgtttttcttcctttcagattttgagatacagagcgagaatggggagaactcaaatgaagacatgtttgagggtgtggagtcacatgggatgttcttgaacatctctggaggggaaggtggtcagcagtctgatggggacagtgactttgagagagactgtggctctggaggcgcccagggacatgccccgggtgaggaccccagggtcgtgccatcggaaggaagggaagttggccagctaataggccttcagggcacctacctgggtgagaagccgtatgaatgtccccagtgtgggaaaacttttagccggaaatcccaccttatcacccatgagcggacccacacaggagaaaaatactacaaatgtgatgaatgtgggaagagctttagtgacggctcgaactttagtagacaccaaacgactcacactggagagaagccctacaaatgcagggactgcgggaagagctttagccggagtgcgaaccttatcacgcaccagaggatccacaccggcgagaagcctttccagtgtgccgagtgtggcaagagtttcagcaggagccccaacctcatcgcccatcagcgcacgcacacaggggaaaagccgtactcgtgccccgagtgtggcaagagctttggcaaccggtccagccttaatactcaccagggcattcacaccggagaaaaaccctacgcgtgcaaggaatgcggcgaaagcttcagttacaactccaacctgatccgacaccagagaatccacacgggagagaaaccatacaaatgcaccgagtgcggccagaagttcagccagagctccgcgctcattacgcaccggagaacgcacaccggggagaagccctatcagtgcggcgagtgcggcaagaacttcagccgcagctccaacctggccactcaccggcgcacccacctggtggagaagccgtacaagtgcgggctgtgcggcaagagcttcagccagagctccagcctgatcgcgcaccagggcacgcacaccggcgagaagccctacgagtgcctcacgtgcggcgagagcttcagctggagctccaacctcatcaagcaccagcggacgcacaccggcgagaagccctacagatgcggcgactgtgggaagggcttcagccagcgctcgcagctcgtggtgcaccagcggacgcacaccggcgagaagccctacaagtgcctcctgtgtggcaagagcttcagccggggctccattctggtgatgcaccagcgagcgcacttgggagacaagccttacaggtgcccggagtgcgggaagggcttcagctggaactccgttctcatcatccaccagcgcatccacacgggagagaagccctacagatgcccggagtgcggcaaaggcttcagcaacagctccaacttcatcacacaccagaggacgcacctgaaagagaagctttactgaagtggcagaaaagagaaggaagtgctgagctgactctgcagggagattgtatcaggtcaggatgatagatctcccagtcggagtcatctgtaggaagtcggagcccttcagaacacagtctgaggaagtatggcctgagactgatgtcccgctgtctcttccattggttagagggacagtgactgccaggaagagtgtcagcttagatgtgtgtgcctgtgtgtggagcacacttggacacacacagttttatgtttggaactcgaggcctctgacctccagcagtcccatcagagtgaaaccgtcgtgcgtgctgtgcactgtgtacacaatcactcttgtacttgtttgttccctgcataagtacctgcaaacacccaacacacacacacagagtgtatgtatcacatagaacgcaggctggccttgaacttatgatgtagctgaggatgaccttgaacttctgatcctcctgcctccaccttctgagtgctgagattaccaggaagtgccaacgtggcgggtttatgttgggcttcaaatcaaacctttgtgcatgccagggcatcacactactgagccatatcctcagtcccatacatctttcagtgtgtgtgtgtgtgtgttggtgtatgtgtgtggtgtgttggtgtgtgtgtgtgttggtgtgtgtgttggggtgtgtgcaggtacttatggagccagtgattaacctccagtgtcattcctaaggcactgttcacctgggagtttttttgagacagagtctctcattgaacctgggactgctcaggctcggctcctggctagacagcctcaggaactgcctctcctgtgtgagggttccaagcatgtacctccacacatgccattgagcataggtgctggactgatctgagagcctcaaacatttacagtgtgtacttgaccgattgagctatctcatatatttttaactttatgtgtgtggatctagcttactgccctgcagttttgtataccaagggtgctctttttaaggacgtgtcaattttgagggtattagaaatctcattgtggggctgatgaaatggctcagcggttaagagcacttactgctcttccagagcatcacgtttcagttccagcacctgcatgacagctcccagccatgtgaaccttcaattctaggaatctgatgaccttctggctctcattggtactctctgcacacggtgcagatacatatatggcagccaaaacacacacacacacacacacacacaaatccttcaaaataggaaggaaggaaggaaggaaggaaggaaggaaggaattccctagtgaggtttagtcttgaatcaggagtttgctctgcagaaccagatgtaatcttagttactaccaaccagggctttatccttaggatcccaaggcgtgaaaggtaaagagaggaaagctgactggagaagtggtgttactgttataaggagaggggagtagacgcagaatctgagaagtgtgaagctatcacctgatatttaggaggtttatgcttggagggggctttcttttcttttcttttcttttctttttttctttgtttttttgtttttcgagacagggtttctctgtgtggccctgactgtcctggaactcactttgtagactaggctggactcgaactcagaaatctgcctgcctctgcctcccaagtgctgggattaaaggcgtgagtcaccacgcctggctggagggggctttttaaaaagggcgttgactattgccaagtggagccccattcttttcctgactgtgcctttaaaaaaaatcgggttgagctatctagttccgactagcctatttcttttttttttttttaaaggatttatttatttactttacatgtatactttatatgagtgcactgtcactatcttcagacacaccagaagagggcatccgatctcattacagatggttgtgagccaccatgtggttgctgggatttgaactcaggacctccagaaaagcagtcagtgctcttaaccactgagccatctctctagctcccagactagcctatttctaaacctcctatctcagcctcttgagtgctgggattacatacatgcttgggtttccatggccagctcctgagtcttatcctctaatgtgtattaaaaacttgaacttggccaggtatagtggtgtgtgcctttagtgtcagcactcaggagcctggagcaggcagagctccatgagttcaataccatagagaactcacatagtgagttctaggatagccagggttacatagtgagacccaggggaaaaatataacctaaccacgactattagcaaacctttccctcacttccatatcctatccacctcccactgcaggccggaaataacctaagactttcaggaaggaaaaattagttgtttcaaagacctgggctgtggtggcacacacctaatcctagcacttgggaggcagaggcaggtggatttctgagtttgagcccagactggtctacaaagtgagctccaggacagccagggctaaataggaaaaccttatctagaaaaaacaaagcagaaagaaatggaggacagatagacggactgacatattattgggttagattcttatcactgctgtttgtgaaccatccatcatgcttgtcacccaagccaggtgtggtgcctcatgcttgtcaacccaacacttgggaagcagaggtaggaagatcacaagtttgaggccagtgtgacctgtaagtccaggccagctttcggcacctgtcttggcatggcacatctggctaagaaatgagagaacactgcgaatcatctctagtcagactcagttaatgtagacagcagggaagttcttggcagtgatggtggactgtggagccagctaggtggttaggctggtcattgattctatcccttggcttatttaataaaggatgcagtgtcattgctgtgctcaatgttaggaaactataaagtcctattaggtgccagataacagagacttgggtgcaccccggaaggtgcaggagctcctgtcagaaaggcagcatagctagaatagtttctcagctgacattaagtctcccgtgtagcccacactggtcttaagcaaagggacagaacgtaccgtgccaagccttctgcctctgcttcccaggtactggcactgcagttttatatgccaccatgccatctcctttcacacgttaatccactctataactttagcctgagacagtccccttgctttaaagatcttactgagatatgacagataaatacataaaagtgtgcagcttgccttagtttcacaagctgcacacacttaaacaagcagcacccagatccagaaacaactgagcatcgataaccagatgtgccaccttgtacctgccttaagtttatggtgtggtagagcctggggggcttctcagacctggttctaaacagacttgtgttgcacagatctgcttttactatacagttgagtcaagtcatagtgaggcggcctctccatggaattctatggaattctacatttatggttcccaatgccatagtagcttctagtgtgagcgaaaggtacaaagctatgctcttactgtcctctctctcagtgacaactccgaggtaagtaagcagcctcactctagggacagactggagacctggggtgtgtggcaggtccatcattagcacctgctcatcctgtgggcacttagctacattgtactagtttcttttaaatttttatttttgcttttttttatatgaggcaaagtctaggagtatagcccaggctggcctcagatttgtagatctcctgtctcagcctcttacactgggcattccaatttgttattaaagctgtaagaaaggacatggtggccaggctgtggtagtgcatgcctttaatgccagcatgtggaaggtagaggtcagtggatctctgtgagctcaggcagacaacctcagctcagtcccttggtcccatatagtgagagaagaaagccagctcccagatgtcgtcctctgacctccgcgtgtgcaccactgtacacattctctacccaccatgtaaaatgtttaagtttcaaaagccaaagcaaagcacaagacactaagaagaacagggatgaaaggaatggatagtaaaaagtggtacattagctagatttaaatctttttctagctagcaggattggcaataactgattagtccttgcaagttaacaaccatcatttttcctggccctttacccctgactggggctgggaggggctggagggggtagagagggtggggaggggtaatcgctaccctctaaccagctccatagcgcagctgccttgttcaacccactctctcacgtggttggggagatctttacatggatgtcccttaagtagaccttttcagatctttgggtaaaatatacatctttctttctttctttctttctttctttctttctttctttctttctttctttctttctttctttctttcttcctgtctgtctttcttatttatttatttatttaattttatttatttatttatttatttattgtatatgaatacactgtagctgtcttcatgcgtgccagaagagggcattggaccccattacagatggttgtgagccaccatgtggctgctgggaattgaactcaggacctctagaagagcagcctgtgcgcttaactgctgagccaactctccagtccaaaatatgcatctttcacttttgcacttctgataaaattaccccaaagccatggaagaaatgagtgtatgattttgtgaatgaaggagaggagttgagacagagatgaattccctttggttttccacattccctacccgagccccttgtagcctaggtctggagtcctttggtaacctgaacaaaggctgtcaccctggggcctgcttgtccttgggtttctctctactgctcacaccttgatgtctcaactctgagttgaacatctgcttgaagctgctgtgggagaaaggctactgagggaaagggctcactgcaggggacagtttgcccagtcattcctccacagcttgctgtgaaccctgtcaaaggagaagcgctctgtcaactgcccaaatgccct

SEQ ID NO: 1572 - DNA, 2094 bp, Mus musculus
gttgtttcttgttgagattggaggaaagacggccttctcagagagcctgactggagacaggtgttaggcttgaagccttcgtgaccatccaggaagttggacaatggcagccgaagtgccagcagtgagcactcccctcagccctttggttcaggtacctcaagaagaagatgaacaggcagaggtcaccactatgatcctggaggatgacgcgtgggtgcaggaagcagtgctgcaggaggatggccctgagtctgagccctttccccagagtgctggaaaaggcagcccccaggaggaggacgcagccgagggaccccagggtgctcttgtccgatttcgggagctctgtcggcgctggctgaggccagaggtgcacactaaggagcagatgctaactgtgctgccaagagaaattcaggcctggctgcaagaacatcggcctgagagcagtgaggaggcagtggccctggtggaagacctgacccagacttttcggcacagtgattttgagatacagagcgagaatggggagaactcaaatgaagacatgtttgagggtgtggagtcacatgggatgttcttgaacatctctggaggggaaggtggtcagcagtctgatggggacagtgactttgagagagactgtggctctggaggcgcccagggacatgccccgggtgaggaccccagggtcgtgccatcggaaggaagggaagttggccagctaataggccttcagggcacctacctgggtgagaagccgtatgaatgtccccagtgtgggaaaacttttagccggaaatcccaccttatcacccatgagcggacccacacaggagaaaaatactacaaatgtgatgaatgtgggaagagctttagtgacggctcgaactttagtagacaccaaacgactcacactggagagaagccctacaaatgcagggactgcgggaagagctttagccggagtgcgaaccttatcacgcaccagaggatccacaccggcgagaagcctttccagtgtgccgagtgtggcaagagtttcagcaggagccccaacctcatcgcccatcagcgcacgcacacaggggaaaagccgtactcgtgccccgagtgtggcaagagctttggcaaccggtccagccttaatactcaccagggcattcacaccggagaaaaaccctacgcgtgcaaggaatgcggcgaaagcttcagttacaactccaacctgatccgacaccagagaatccacacgggagagaaaccatacaaatgcaccgagtgcggccagaagttcagccagagctccgcgctcattacgcaccggagaacgcacaccggggagaagccctatcagtgcggcgagtgcggcaagaacttcagccgcagctccaacctggccactcaccggcgcacccacctggtggagaagccgtacaagtgcgggctgtgcggcaagagcttcagccagagctccagcctgatcgcgcaccagggcacgcacaccggcgagaagccctacgagtgcctcacgtgcggcgagagcttcagctggagctccaacctcatcaagcaccagcggacgcacaccggcgagaagccctacagatgcggcgactgtgggaagggcttcagccagcgctcgcagctcgtggtgcaccagcggacgcacaccggcgagaagccctacaagtgcctcatgtgtggcaagagcttcagccggggctccattctggtgatgcaccagcgagcgcacttgggagacaagccttacaggtgcccggagtgcgggaagggcttcagctggaactccgttctcatcatccaccagcgcatccacacgggagagaagccctacagatgcccggagtgcggcaaaggcttcagcaacagctccaacttcatcacacaccagaggacgcacctgaaagagaagctttactgaagtggcagaaaagagaaggaagtgctgagctgactctgcagggagaactcccacagtgtccctccccacaaccctccccccacaacccccctcccccccgcccgtgttgtccctttaaaagaaccacttttcctaaataaaaaaaa

SEQ ID NO: 1573 - DNA, 1845 bp, Mus musculus
atggcagccgaagtgccagcagtgagcactcccctcagccctttggttcaggtacctcaagaagaagatgaacaggcagaggtcaccactatgatcctggaggatgacgcgtgggtgcaggaagcagtgctgcaggaggatggccctgagtctgagccctttccccagagtgctggaaaaggcagcccccaggaggaggacgcagccgagggaccccagggtgctcttgtccgatttcgggagctctgtcggcgctggctgaggccagaggtgcacactaaggagcagatgctaactgtgctgccaagagaaattcaggcctggctgcaagaacatcggcctgagagcagtgaggaggcagtggccctggtggaagacctgacccagacttttcggcacagtgattttgagatacagagcgagaatggggagaactcaaatgaagacatgtttgagggtgtggagtcacatgggatgttcttgaacatctctggaggggaaggtggtcagcagtctgatggggacagtgactttgagagagactgtggctctggaggcgcccagggacatgccccgggtgaggaccccagggtcgtgccatcggaaggaagggaagttggccagctaataggccttcagggcacctacctgggtgagaagccgtatgaatgtccccagtgtgggaaaacttttagccggaaatcccaccttatcacccatgagcggacccacacaggagaaaaatactacaaatgtgatgaatgtgggaagagctttagtgacggctcgaactttagtagacaccaaacgactcacactggagagaagccctacaaatgcagggactgcgggaagagctttagccggagtgcgaaccttatcacgcaccagaggatccacaccggcgagaagcctttccagtgtgccgagtgtggcaagagtttcagcaggagccccaacctcatcgcccatcagcgcacgcacacaggggaaaagccgtactcgtgccccgagtgtggcaagagctttggcaaccggtccagccttaatactcaccagggcattcacaccggagaaaaaccctacgcgtgcaaggaatgcggcgaaagcttcagttacaactccaacctgatccgacaccagagaatccacacgggagagaaaccatacaaatgcaccgagtgcggccagaagttcagccagagctccgcgctcattacgcaccggagaacgcacaccggggagaagccctatcagtgcggcgagtgcggcaagaacttcagccgcagctccaacctggccactcaccggcgcacccacctggtggagaagccgtacaagtgcgggctgtgcggcaagagcttcagccagagctccagcctgatcgcgcaccagggcacgcacaccggcgagaagccctacgagtgcctcacgtgcggcgagagcttcagctggagctccaacctcatcaagcaccagcggacgcacaccggcgagaagccctacagatgcggcgactgtgggaagggcttcagccagcgctcgcagctcgtggtgcaccagcggacgcacaccggcgagaagccctacaagtgcctcatgtgtggcaagagcttcagccggggctccattctggtgatgcaccagcgagcgcacttgggagacaagccttacaggtgcccggagtgcgggaagggcttcagctggaactccgttctcatcatccaccagcgcatccacacgggagagaagccctacagatgcccggagtgcggcaaaggcttcagcaacagctccaacttcatcacacaccagaggacgcacctgaaagagaagctttactga

SEQ ID NO: 1574 - DNA, 30000 bp, Homo sapiens
tttgaagccaaagccaggctacacagagatgaggctcctgggagggaacaggtgcagtcctgctcaggctgcagtgtccctgggctacagctggacaagggctccctctgggtcacagcctctagggacagagtttggggcaggttgactgtctgatttgtaggactctggtgatgagctcagctgggaaactgtgtggtaatgggaagagaatggttttgcttttccaaatcatccaccctctgcatgctttgatccatactggaactcagtgtggaaacagtgcctttgaacagcctaagcctaaactctgggctgtgtgtccagtttcctggcctccagcttagttcactccttaccccgcccatcactgataccagatccatcctcccaaatatcctttcatcatgttacctccctaccacctcatggcaccttcaacacaacaggaaatgtctccaacctcagcctggtattcaaggttctttctgatgtggcccacctctcaccactccaccacatctccctgtgggccctgccaaactggatcattttttttctatccatgagctgtgaactttcccacctccaaattgttgcttatactgtgtccttcctctgaatgttctcttcctccctctcccccagtccaaatgctatagactgaattgggtctccccaaaattcatacattggagctctgatctgctatgtgattgtatttggaaatagagctcttaggagataattaaagttcggtgagggaggaggagcagatcaagatggctgaatagcagcctccaccaatgattctccttgcaggaaaatcaaatttaacaactgtccacagcaaaaaagcatcttcataagaaccaaaaatcaggtgaggactcaaagtacctggctttaacttcatatcgctgaaagaggcactgaggagggtgggaaagacagtcttgaaacactgatgtcacccctcccccatccctcagcagtggccgctgtggtgctgagagaatctgtgcacttgggagagggagaatgcagcaactgtgggactttgcactgaactcagtgctgccctgtcacagcagaaagcaaaaccaggtggaactctcatgacacctgcccatggagggagcatttagaccagccctacccagaggacttcacccatcccagtagttaggaggcttgaggcttgggttttgacaagccttggcatggcaggctatcatgctctggggccctaaataaactttcaagccagtctagaccataaggacttcaactcctaggcaattcctaatgccatgctgggctcagagccagtggactcggggcacacaacctagagagacaccaggcaagggagccaagggagggtttgcaccacccctcccccaaccccaggcagcacagcttgcagcaacaaaagtgacttcttccttttgcttgaggagaggagggggaagagtaaagaggactttatcttacatcttggataccagctcagccacagtaggatagagcactagtcagagttgagaggcctccattccaggacgtagctcctgaattacatttctagatacaccctgggccagaagggaacctgctgccttgaaggaaagaacccagtcctggcaggattcatcatctgctgactctagagcccttttgacccaaataacctgcagtgatacccaggtagtatgctatgggcctggagtaagactctgaggcatgctggcttcgggtgtagacccagcatattcccagctatggtggctgtggtgagagacttcttctgcttgagaaaagcagagagagatgcacaagggactctgtcttgcagcttaggtacctgcctggccacaatgtggtagagcatcaaatgggctcttgtggtcactgattctaggccttggctcttagacagcatttctggacctgctctgacctcaccctgaagggtgagtcccaggcctggaagcattcaccacaagcaactgaagagcccttgggccctaagtgaacatagccagtagcttggcagtactcgctgtgggcctgtgggggtggccacagggtgaggctcctctgcctgtggaaaggggaaggaagaatgggaaggactttttcacatggtttcagtgccagttcagccaccatagactaaagcaccaggtaaatttctgaggtttttgactccagtccctggctcccagacagcatctctggacccgccagggcctgagggaactcattggcctgaagggaaggacacaaacatggctggctttgccacctgctgactgtagagccctaggccttgagtgaacataggggatagccaggtagtgtttacagcaggctttgagtgagacccagtgctttgctggctttaggtctgatccattgcagtcccagtggtggtggccatagggatgttgtgtcagcccacccctagctccaagtggctcagcagagagagagagactgagactgtttgtttgggagaaatgacaggtagaggataagaatctctgcctggtagtccagagaattctagatcttacccaagaccaccaaggcagtacctctatgagtctgcaagaaccatagcattactgggtttggcgtgtcccctaatgcagatacagtttagatcacaagacccacatccttcaaatacctggagagccttcccaaggatgggtacaaacaaccccagactgagaagactacaataaatacataaatcttgaatgctaaggcactgacaaacaactgcaaccatcaagaccatccaggaaaacatgacctcaccaaacaaactagaggggcgaatcctagagaagcagagataagtgacctccagacagataatttaaaatagcagttttggggaaactcagagaaattaaagataacacagaaaggattcagaattctataagataaatttaacaatgagattgaaataaaaagaatcaagcagaaattctggagttgaaaaatgcaattgacataatgaagaatgcatcagtctcttaattgtggaattgatcaagcagaagaaaaaattagtgagcttgaagacaagctatttgaaaatatacagttagagaagacaaaaaaaatttttttttaatgaagcatgcccacgaaatctagaaaacagcctcagaagggcaaagccaagagttattggccttaaagaggaaacagagaaatagaaagtttattcaaagggataataacagagaactttccaaacctagagaaagctataaatattcaagtacaagaagattatagaacaccaagcagatttaacccaaagaagactacctgaagacatttaatactcaaactcccaaaggtcaaggataaagaaaggatcctaaagcagcaagagaaaagaaacaaataacatacaatgggactccaatacgcctggcagcagactttctgtgaaaaccttacatgccaggagagagcagcatgacatattttaagagctgaaggaaaaaacttttaccctagaataacatatccagtgaaaatgtcctttgaacatgaaggagaaatagactttcccagacaaacaaaagctgagggatttcatcaacaccagacctatcctacaggaaatgctaaagggacatcttcaatcagaaacgaaaggacattaatgagcaataagacatcatgtgaagttacaaaactcactggtaatagtaagtacacagaaaaacacagagtattataacacggcaattgtgcaaacaactcttaagtagaacgactaaaagatgaaccaaacaaaaatagtaataagtacaacaacttctcaagacatagacagtgcaataagatgtaagtagaaatagcaaaaagttaaaaagcaggacaaattaaaatagagtttttattagttttctttttatttgtttcattgtttatttgtttgttcctttgtgcaagcagtgcaaagttgtcatcagtttaaataatgggttataagatggtatttccaagcctcatggtaatctcaaatttaaaaatatgcaataaatacacaaaacacaaaaagcaagaaattaaatcatactaccagagaaaatcaccttcacaataaggaagacagaaagaaaagaagaaagagaagaccacagcaaccagaaaacaaaatggcaagaataagtcaatactaacattgaatgttaatggactaaactctccaatcaaaactgttatggaaagaactgttatggagcagttctccccattcccacccacatcatttttcatcaactctagatgagctaagggcccccaaatgccttaggctgagcattccttggggtgaggtcccttcttgctcagagcctaaagacaagtagtgatattgtttctgcctgtccagtgtttcctaacaggccttcagtctccagagtggagaatctgcctttgtgtggggtattagtaagaaaatctaggagccacatccaatcctctctcaccctgctgcatccagggaatgtgcatgtgacttagactcaaccaaccaaatgctctttccttgcatgggagaatttgtgtgagaaaggcggagaaacagagatggctgtagtaccaccagaggtcatgggataggcaagctgaactttttctgctcagagactgttattgtggtttttggggacttcctctttgtctcttggctcctaactgttctcaagcctgattcgtcagctcccttctactctgtcagttccctgacagtctttcagtaagtcccttttacttaagttagccagattagttcttaagcttttaaccaagaatgctttctggtggaacagagcctctctcacccttgtggtttggccaatggagaaaggactctcttgggggagcaaccttgaacttggctgtgtttccaggcttgcttcgatgtagcaggctggtcttagggtactggcttggctaccagggcccttctcagtaggatcattatgccatgaattggtcttaaatgtgactttctctctgtctcatgtaggatagttgacactggcaaggaccagcttcccagaatcagacacagaggagacagcttctttaggactctccagtgacaagctagtgccagttctgtggtcaagggttgacatgggttaggaacagaggtaaataaacgcttgagctgctggaaagttccatctgtgcatccccagcctcccctgcatcttttcctttttgtgtaaatttccattcctggtaaggatggacacatggagaaacccatcttttttaatacaatgtcatcccaaaaaaaatcacttggaggggtggtggcccagaattctgcatccaggggcttagtgcagacttctcaggctggcctggaggtggtgctatttgcatgtggtcagtctgggataataaagatgctaccagggtattggataagaatcactagctgaacttcactttgcatctctgtaattggattcaagaggttaattagtgaaaaacaggtgaatttcacataatctttggagtggtgcagaggactttctaacacaaaactcacaggctataaaaagataagattaacaaatttgactgcaaaaaaatttcaaatttctatatttaataaaccagcagaaaacaaacagcaaactgagaaagagtagcaactgctgtgacaaagggataattttcttaatatacaaagagctcttacaaataaatccaatttaaaaatgggaaaaggaccgggcacgtggctcatgcctgtaatctcagcactttgggaggccaagacggctggatcacctgaggtcaggaattcaagaccagcctgatcaacatggtgaaatctctgtctctactaaaaacacgcaaaattagccaggtgtggtggcgcacgccggtaatcccagctacttgggaggctgaggcaggagaatcacttgatccgagatcgtgtcactgcactccagcctgggcgacagaggaggaaaaaaaaaagcagtcatttcattgcaggtgcctccagtaattgctcagtgcaaacatacataactattctatcacagaccattaagggtgtctctctccatttttagattttccgcttgagtttccaggtagtttctcacctgttttcaagcagggttggggcagccgtttcttcaacagcgccagccgtaaaacacaaagatggaggccaacctcccacacccgggcaccctcccttcccccatactgagattgacaagtaagcaacccggtgatcagtactaaaatggagacgtcagccaggtgcggtggctcacacctgtaattccagcactttgggaggctgaggaggaaggatcgcttgagcccaggggttcgaggtcagcctgggcaacatatggaaaccctgtctctatgaaatgtagatcctgtctgtgagtgtgtgtgtataaataaatatatatatatatatacaaatacatacatatatatatttaaaaaataaaatggggacgtccaacacgtgtactaggggcggtgtctctgcctggggaggtggtgatgacagggcaggctccacccaggagaagctggaagaatgggagttccgcggcagaggaggcggggcagggcgttcctccaaacacaggaataccacgtgcgaaaacaaaggggtgtgcgaagaccgggtgcatgtgtacagctgcaaactgggggaaaggcgccaggcttgggcgatgaggatttgttcccccatggattcccttcctgcccagggtccgctctcgccggtcgagggtgcctaacaatactccttgccacaaggttcgcagccgaaaaggtccttcaagtccggccatccaactttcactttttatagacaaatatacagaggccttagataagtgaaacggcttgtctcgggttacagctctagccaacacagggtttctgacggtcagtctgcggattttcctgcctctggtccgcaggcactgcccaggctgtcagccccaaaccctactccggggaccgcggtcaggttcgtctccgggcggactacatctcccacaatgccttgggcccagcctccctcctgccgcccggctgggtgccgtctccaccaacagaaaggcagaatttccagggccgttctcggcagccaatgagcgcggcggtgggcgggcctctcccgtccattgttctcggtgccccacgggcttgagccggggtgaatctggaggggccgggccgagcccgggggcgctttcgcacgcgaagcaaccgctagagcaggacctggtctcccgagaggtgagccggagaggcaggcctggagccacgcggaccccgggcagtagcccgaggtgagggaatagtgggcctggagccagctgccggcagctctgctgggggaggggcgtcggggtcgcgctccgtatcctgcgggccctgcagccccgatttacgcgccggctccgctcagcgaaccgtcccggacgcgtctccctggcggagagctccttgcctctcctaccgagaagcgcaggctttggacgggaaggggcattcgacgacatcccgcgcagcgtacacgttttacagatggggaaactgaggttcagagggggcgtgtcgtgccccaagtcagaccgcaaattagctgacctggcacacttttcccaggctcccaagtaggaagagttctcttacaccatatgccagtatttcttctagtcatttgagtaaatacacgttgagagcttcggttttcccactagcttttattttttgtccttttttttttaagcttttgtcagcttttctccccttttcattgagggagggttgttagttgagtctttatgatgtagtaatgattttttaaaaaatttttttatttttgtagagactgggtctcactctgttgcccaggttggtcatgaactcccggcctcaagccatcttccctcctcggcctcccaaagtgctggaattacaggcgtgagctacagcgcttgggctaaaaataattttgtattgcttttataatattttaagtcgtttgcaattccactgctttcaatattttgtaggtgccgtcccgttcttttttcctgtgagttcatttttttttttttttttttttgagacggagttttgcttttgttgcccaggctggagtgcaatggcctgatctccgctcaccgcatcctctgcctcccgggttcaagcgattctcctgcctcagcctccggagtagctgggattacgggcatgcgccaccacgcctggctaattttgtttttagtagagacgaggtttctccgtgttggtcaggctggtctcgatcttccgacctcaggtgatccgcccgcctcaacctgccaaagtgctaggattacaggtctgagccaccgcgcccggctgtgagttcatttttaaagggaattgaggacttactgtgtctatggtttttctgccctgctgattttgtgtttatccattattttcctatcagaaggattatcttaaatcattaatgattaatctttgtcaatataatttttaaaatattaaaaacatacagcgtaatgtgcagatcttaaatttcatatgtttgctcttgtgccgccattgccaaatgaagatattgaaaatttccatcatcccagaaggctcctttgagcccctttcctgtcattaccacctaaaggtagccattattatagcacagtttcttttcttttttttccttttcttttctttttttttttttttttttgagacagagtctggctctttcgcccagactggagtgcagtggcacgatctcggctcactgcaacctcctcctcccaggttcgggcaattctcctgcctcagcctcctgagtagctgggattacaggcgcccgtcaccatgcctggctaatttttgtatttttggtagagacggggtttcactatattggccaggctggtctcgaactcctgacctcaagtgatccgcctgccgaggcctcccaaagtgctgggattacaggcaaccacgccaagcctatagcacagtttctaatacatgctgctatatgggtgtgtcatagtttattagccattccctgctgctggatttttaaggactcgattttttggttatttttttaagataaagtactgaggggccgaggctggattggagagtatatgcatgttttaaacttcatacttaaagtatggtaataatgcagttgagatattgcctttcttccaaagaagctcagagtgctttgacatctgatccattgctgatccttaagatgcccccataaaaacagaaacatgagtgttattatctttattaggtggtcaccgagtttggtgactaagttgtatgttaggtcaaggtcacacagtgcaagtcgaaactgacttaggagagtcctcagtatttcagtcatgggtttttcccggggactttgcatttctgatactcattctttggtgttttggaaggaacaatgctgtattttttgtgcttgggatacttttttttttttttttttgagacggagtctcactctgttgcctgggctggagtgcagtggcgagatctgtgctcactgcaacctccgcctcctgggttcaagagattctcctgcctcagcctcccaagtagcaggaactacaggcccccgccaccacgcccggctaatttttgtatttttaatagaaatggggtttcaccatacctcaggtgatccgcccacctcggcctcccaaagtgctgggattacaggcatgagacactgcacccagccttcttttaccacagagagatgttttcaggaataagccattttttctttaagaagaacaggaaacgtctgttggtttgcatatgtaagggccacttggtggtctgacctgggcttttgtgagttagattgctttaggacagtctacctatggattatggttctcttttttgtttctcagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtggtgagacgcagaacctcatagggagagggcgggagcacccttccaaggtagaggagtgtggtgtttcggaggaggagaaggtggtgtccaaggcagagtggggggctagcgccatccctctgctctgtctgcaggcagtcagcgtgttcatcagccttttagtgtcctcactgtgtgcaaagtcagctccagaagtgctaggagggccttagagctacatttgaattgtaagcacagtttttacttctgtgtttatttggagtggttgggaaggtgatggaagttaaacgggaggagatggagacccctggcaccttcacgtggttgtgcaagaaacatccaaatggttcttgcaattagagaaaacaatctgatattttcaacatgacttttttttcttttttctttttttttttttttttgaaacggagtctcgctctgtcacccaggctggggtgcagtggcacaatcttggctcactgcaacctccgtcttctgggttcaagcagttctcctgcctcagccttttgagtagctggaattacaggcgtgcgccaccacgcccggctaatttttttatttttcgtagagatggggcttcaccatgttcgccagactggtctcaagctcctaacctcgtgatccgcccacctcagcccccgaaagtgctgggattacaggcgtgagtcaccacgcctggccccaaagtggttatttttatgaaaccaagagaaatgacaagtaaaccagctaataactagggactttctgtggtataaagtaatcctgggctcttaaaatcgtaatttcaaacttgagctctttgcaatagttactctatttttttccggtgttactaataagtattgggattctggcttgccgtttaaccgctgtctccctcctggttttccattgtaaagtagactcacttgatgaccaaatgtttacttcagatgtgccttgagggctgtctcagggctcgaaggatatggctgcctttgtgctgatgaaaactacggaagttcagagaagggagcgtggagaggaaaggtcaggtcagagaaggcttcctggaggaggtgacacctaagcaggaggttgtagaagggagtagggtgtggcagctgagaggagctgtgctgagcagaggcttggaagggcagagccacggtggtttatacctttgggtgacaggagagctggcagattggagtggcaagtgtgtttttaggaagtggtaggaagtagagtttgggggaagggtgggtgagggcttggactgaatgttttgcctcagtgggttcttgaactagacccccaaggggcatggaaggaagcggagtttggcaacaggatgtaggtttgattagggtagtgagaggctaggggcaggagagcagccaggaagctcccttgtcttcaggtgtgcagtgatgggggtctgccccagatggggcacgtgtgagaaagaactgatagtcaccatggctagcactttccaagctctttctgcaagccaggaaatatgcttagcatctaatatggaaaactcatgtaatcttcaccaccctggaagataagcaggattatcatcaccagagatcccttaagatcatgtgcctttgtaccaggcagaaccaagatttgaacttatgtgtgtgaggacatagcccatgtttttaagcgttgtcatatgtatgattctaagagacacttcctagtgggtgttggaagttggggatgcagatggaattaagacagtgactacagagcatctggcctggaggattcagaggactgggaagagaagagaaggaaactgaaggggatttggggcagagactatcacaaactccagggactgggtgaatgagtagagctgtcctctggagaaagggactgacgccgaaggtctgcagtgacccagccctgccctgggcaccttcatgcttgtctcactaagaatcctgtgagtggctggcattgtcatttcacagataggaaatataagtgcaggaaactcacatggctgttgagtggtggagccaggattcaaacccagacctgtctctttctgcatggagatctcagttttgcttgaagcaaagtgcttgattttctttggccctgaaaaaataactgcattttattccttctattaaaataagcaaacctgtctccctattttacagctgtagctgtcgttgcttcccttccggtggaggtgaccagtttgtaatgaacttctggatctccagtcagatactatggaggagagagtgatggagggctgaggagaggcctcaggttgttatttggttggggaggcacagagcagaggttcaggtctcagcaggtgtcagaggtgattacagcccttcccatccaccttgcagcaggggctttgtgcctttcatctttaactgggcacctgagatgggaaccaatggggaccatcccagacacatgggtttgtctgtccctgacttctgcctctgagattgtctttgttggtctttgtttaataaacgccccgaccttcctcatgattgctcacaggagtccctgcgtttgtcttcatcccttctcaaacatttactcgacataaggccgcgtgacctctattctgtttgtccagcttatgacctttggacacattcacccagcacaggatatttccaggcctggttagtcagtggcggtttaatgtttttctgacaggaacctctgggcactcaaaattcaagtaccttctaattctaatgaagatcggacctatattaatagattaagtggcagagcttatgtctctctgtgactgtttccagaggacattttactctccatacccagccctaatccagatgcgtggagtttctcacctgaattcttggagcagctgccaaactgaacctgtcttcagcttctgccccttcatcccagctcttccacttctaccagagtgatggggcactcctgcttaaaaaccttcatgagcttcccagtatctaccaaatcaagcatgacctccttgttctgcttggaatccgtggctctgtgggacctggcccaaacctcccctgcagtcttttcccacccctgaccccccatgctctatccccactccattcagaccagatcttgctctttcttgaacacagcctgtgcttttgtttttgtttttgtttttttgagacggtctttctacgttccccaggctggagtgcagtggtgccatctgggctcactgcaacctccacctcctgggttcaagtgattctcctgcctcagcctcccaagtagctgggattacaggtgcgtgctaccgtgcccagctaatttttgtatttttagtagagacagagtttcaccacgttggtcagactggtctcgaactcctgacctcaggtgatccacccaccttggcttcccaaagtgctgggattacaggcgtgagccaccacgcctggcccttgctcctggatttttggcttggaatagccttgtcccatctctgtgataaaatcccagttgttctttgagtgcccacccgtggagaccctcttcataaagctgctcttaaaccctgtcccttttccccatccccagttccacacacctgggagcacctctaatcacctctgctagaagtcgtctcccccagaacatttggattctctctcttggctttttatcatagttcaccttcttttctgtttatatgaatacttgtcttatttcttctaggaacctgtaaaatcctagaagacaaggaacctgtctttttcctttctctttcattccccctcttccctctcttccaccctactccctcttcctttccctctcccttcagtatcatgaacctcggagccccaccctagaactcctgaatcagacactttgagggtggctgggcgcaatggctcacggctgtaatcccagcacttggtgaggccgaggcgggtggatcactcgaggccaggagttcgagaccagcctggccaacatagtgaaaccctgtctctgctaaaaatacaaaaaaaatcagccaggcatggtggcatgtgcctgtaatcccagctacttgggaggctgaggcaggagaatcgcttgaacctgggaggcggaggttgtagtgagctgagattgcgccattgcactccagcctgggtgacagcaagactctgtctcaaaaaaaaaaaaaaaaaaaagaaactgagggcgatgcccagcattctaagtgatcctgattcaaactccaatttgagaacctctgcactagacctctgtagacctctggttctcaaactcagccgcacattagaattacctgggggcctggagcctactccagggattctaattttctgatttaattggtatggggtatggcctgggcaagggagttttgaaagtgcccaggtagttctattatgctgcaaagtgtaaagagcactgccatagagctttgttcttcagggggtggtcagtgggccagcagcatcagctcacctgggagtttgttagactaggactgtcagtctcaccaagccccgctgaagcaaatttgcatttgacaagatctccaggtgattcctatgctctttgaagtttgaaaagcactacccaggagaggaatagaggttatcaacttcaagcctactcttgtccaacagttgagtgaaagagtcacagctgacctctccagccatcctcagcatcatctggctttcagccatcagaggcaacaggtgatttgttttgagcttgctgccccagcaaaatgctcccttaatgaccacaaatgaacacatacattcatttgtctcagccagaaagggagtggagagtgttacagcttatgtctttttaaagctacaattcttagcttcaaaacaaaattacttttatatatatatatacacatatatatctatgatatatatcatatatgatatatgagatatatgatatatctcatatgatatatatatgagagagagacaaagtctcactctgtcaacccaggctggagtgcactggtgtgatcatagctcactataacctcgaactcttggcctcaagtggtcctcctgtttcagccacccaaagcactgcgataacaggaatgagccactgtgcccagcccaaaaattacctttaatttactcaaatgtttgaaaagtataccggacagaattcttagggagcggtaacgttatacctatgaaatgtttagcattcatgtatttcacctgataacagtccattgctgtttttatcagcagttagtctttcaagcagccagagttcagggggaacaatgctcccagtcccactggcttgccagggcagcgctctaatggggagagccctagtgagaatggagctgggcataccctatatcagaaccacttctctattttagaccagtggctgagacacaggggtaggacacaatcaggcaggaaggggctggagaagaattttgagccaaacacacaccaaagcaccaaagactgtgaccagtttatttcattgttacagcaaagtcaggtctatcccctattgacatgagtcttccccatgttcattctggtatgctctatggtgcgggagagaaagaggaggcctgtggccaggcgaggacacgcagggccctgtgaacggccacgggaatttgtgctgtgcacgtgaggccagagctcacgtggcaagtgcgagaaatacaaggaccgttggctgagattgagctacggtggcagcttttgtccactgacagataaggggagaggtcctgtggcccttcagggactgttccagtgaatgatttttggacagtggtcaaatcattttgaaaaaactaaaattggatacctactttgcagcttacaaagaaatagatccctgctttacaagttacacaaaaataggtcccagatggattacagatctgtaatagacaggatctgaaatgacatgtgagagaatatttttgtaatcttagcatgcgggaaggactttcatgtttgtttgacaggaacctctaggcactcacaattcaagtatgaagtgtgaataagcaatacagaagtcatcaaagctagattggactcaaaacagaagtctttctttctttctttctttcttttttttttttttttttgagatggagtctcaccctgtcgcccaggctggagtgcagtggcgccatctcggcactgcaacctccacctccagggttcaagtgattctcctgcctcagcctcccgagtaggtgggactacaggcacccaccaccactcccggctaatttttgtatttttagaagagatggggtttcaccatgttggtcaggctggtctcaatctcctgaactcaggcaattcgcccgcctctgcctcccaaggtgcagggattacaggcgtgagccactgcacccagccaaaacagaagtgtttcatataaaaaacgatactgtgaatcaaaagacagcatacacattaggaggaaatatttgcatccaagtctaatgtagcagatcatgagtcaaaatccttgatctacaagagcctctgcaaattcataagaaaagtcaaccaaatagaataaaaggtaaaagatataaacaatttagaaatgaagaactaaaaattatgaaaatatgttctggccaggtgtggtggctcacgcctgttatcccagcactttgggaggccaaggtgggtggatcacgaggtcaggagttcaagaccagcctggccaacatggtgaaaccccatctctacgaaaaatacaaaaaaaattagccgggcatgtggtggtgtgcacctgtaatcccagctactggggaggctaagttaggagaattgcttgaacccaggagacagagatcacgccactgcactccagcctgggtgacagagcaagactccgtctccaaaaaaaaaatttttttctttttaattagccaggcatggtggcacacacctatagtcccaactacttgggggctgaggtgggaggatcacttgagcctgggaggtcaagacttaagtgagccaagatcccaccactgcactccagcctgggagacagtgatatactgtctcaaaaaacaacaacaggccagtcgtggtggctcacactgtcatcccagcactttgggaggctgaggtgggtggatcacctgaggtcaggagtttgagaccaacctggccaacgtggtgaaacctcatctctactaaaaataaaaaaattagctgggagtgatggcaggcgcctgtaatcccagctactcaggaggctgaggcaggagattcgcttgaacctgggaggcagaggttgccaagatcgcgccactgcactccagcctaggcgacagagcgagactgtctcaaaaaacacaaaacaaaacagaaaagcaagaacaacaaaaaagtggatgtctgggccatccagcctcttactcataagcctgcttccttagaagccgcctccctacatctactcatatccacagaatgtgctcctcttggcatcctggagtagccaaagccattgctatcagtaaaaaaatttttttttaattcccagctgccaccatctcctctcatctccattcacaacgtggtaagaatattatttttgtatctgaccaaaaccagtttctgagttttcattttcttaattggccaccaataaataaaggagggactcacctgcccttgaacgtgctctgctgtgtgctctggatctcataggggccagcctttctcagggagcctggagggggccagggatcccttattcttcccagctcagtgactttttcccattttggaggcccttgtcagtcagatcacctgaagggccactcttttctgtcctgtagaatgactcctgtgtctctctggtcttagagggcaacttgtgaagaactgccaaccttcctttggtcttcgctggatagcagcggtgtttgtaaagataggactggtctttgagcagtacagtgaaggggttattgggcctggattctactcagagggacctccttagtgaggtttatgatatttatgttatacagcaatgtagaaatgaccttctaaaggccaggagcggtagctcatgcctgtaatccgagcactttgggaggccgaggcaggtggatcacgaggtcaggagatcgagactatcctggctaacacggtgaaaccctgtctctactaaaaatacaaaaaaattagccggacgtggtgtccggcgcctgtagtcccagctactcgggaggctgaggcaggagaatggcgtgaacccggtaggcggagcttgcagtgagccgagatcatgccactgtactccggcctggaagacagagtgagactgcgtctcaaaagaaaaaaaaaagggggaaatgacattgtaaccaaaattggggttgggaggaataaggtggttttataggatatgttctttgattgtcttgtatgtaatacctgggagttcaaagacttgacatttaaaagaagatagccccataaattaagtatcgcacttaaaggctgccagattttaaagaaattctttcatatgttcatctaatagtttgatgctgctatttgggttttttgttttaacatttaaatcttagatccatttgggatttgtccgtttctgggtccagcttgaatttttccatttgaattgaatttttccagttttccgtaactagttcttccagcatcatttattgtatgttgtgtctcttctccatggatttaagaggccaaccgtattgtatgctaaattttcatagtcattatacagattatcttttctcttctcttggcctgtctatttctgttccacttgtattaaattctgaacttacatatctattgaatctatttctggagtttttattttgtttatttggtctgattgtctattaatgttttaattattgagatttcataatgtttttgtttttgtttttgagacggagtctcgctctgttgcccaggctggaatgcagtggcacaatctcggtacactgcaacctctgcctcctgggttcaagcaattctcctgcctcagcctcccaagtaggtgggattacaggcgcccgccaccacacccagctaatttttgtatggggtttcaccatgttggccagggtagtctagaactcctgacctcaggtgattcactcgcctcggcctcccaaagttttgggattacaggcgtgagccactgcacccggccgagatttcataatgttttaacatctgacagagatagtccctctcccctccaattttagtcagtaatctttcttttttttttttttgagatagaatctcagtctgtcacccaggctggagtgcagtggcacgatctctgctcactgcaacctccacctcctgggttcaacgattcaacgattctcctgccttagcctcccaactagctgggattacaggcatgtaccaccatgcccagctcatttttgtatttttagtagagatggggtttcaccatgttggccaggctggtcttgaactcctgagcttgcgatccgcccacctctgcctcccaaagtgctgagattacaggtgtgagccactgctcttggcctctttttttttttttttttttttttttcagagacagagtctcactctgtcacccaggctggaatgcagtagcatgatcatagtttactataatctcaaactcctggcctcaagcaatcctcccacctcaggttcctgagtagctgggactacaggcaagtgccaacacacccggctaattttgtttttttttgtagagatgaggtcttggctgtgttgctcaggctggtcttgaactcctggcctcatgcagtcctctcacctcagccatccaaagtgctgggattgcaagcaataatcttatcttttttagtgtttatttttgcaaacctctacttagctgcatgctttaccagttttaaatgtgaattctttgaactcccaggttattacagatgaggcaatcaacgaacatatcctataaaccaccttatttctcccaaccccagttttggttagaatgtcatttctacactgccgcataacattcacaagctctttaatcaccccagttgccatggtagttttagtcttcattctaaagttaaatttattaggtgttcacccctctagcagtccattaatttgtgtatgttcaaagctgtttgcctataggtttatacttgaaggacagttttgtcgaatatagagaaatcttttttttttcctgagatagagtcgcccaggctggagtgcagtggcgcgatctcagctcaccacgacctccacctcctgggttcaagcagttctcctgcctcagcctccggagtagttgggattacagtcacgtgccaccacacccagcctgaatatagagaaatctgaaaccagttgattttctttccccttgtaagtgatttgatccttttgctgttgtccactggtcttactgttagccaccctgggttagtttttgttggcccatggtgtaactttcacatgttcttatatccttacaggttttatctttaagtattagttctttttttttttgagacggagtctcactgtgtcgcccaggctggagtgcagtggtgtgatctcagctcactgtaacctccgcctcccgggttcaagcgattctcctgcctcagcctcctgggtagctgggactacaggcatctgtcaccacacccagccaatttttgtatttttttagtagagacggggtttcaccatattggccaggctgatcgtgaactgctgaccttgtgatccgcctgcctcagccccccaaagtcctgggattacaggcgtgagccaccacgcctggcctttaagtactagttctattgctttgtttttttgagaactccagttatgtttactgattctccttttgcctaacttctgtttctatctttttgtttaagatagggtctcactctgtcacccgggctggagtccagtggtgcaaatatggctcactgcagcctctgcctcctggcctcaagcaatcgtcctgccttggcctcttaagtagctgggtctacaagtgtgtacagccacacctggctaatttttgtattttttgtagagatggggtgttgccatgtttcctaagttgtcccaaactgctgggctcaagcaatccacctgtcttggcctcccaaagtgctgggattacagacctgagccaacgcgcctggccctctgtcattctttttaatccttttaacctattcctttgtttccatttcctgtcattgctttcttattttggtcctctttttcccattcttggaatggtgctttccaagatgcctattcccattgcgctccttttcctgttgtcttcatttctctggctgattttccctcctttcctgagttcttctagtgtacatttaatctcttcctgttgtctcaccatcccttcttcaagctcttctctgtggtattcctttataaaggcagttgcctcatttaattatttttatggatggaaatgatcacttttctcagtaatagtaattccttgggccgggctccagcctataatcccaacactttgggaggccgaggcagttggatcatttgaggtcaggagttcgagaccagcctggccaacatggcgacaccccatctctattaaaaatacaaaaacaatgagccgggggtggtggtgtgcacctgtaattccagcttgtcaggaggctgaggcaggagaatcgcttgaacctgggaggcagaggttgcagtgagccaagatagtgccactgcactccagcctgggtgacagagtgagacttcatctcaaaaaaataaataaataaataccttggattaatgtgcgtgggtcaaaggctctttccttctctgctttccagaaacagcttcctgcgtacatggctgccctgtgtgattccagttgcagcctcacctcctttgcctctctgaaccaaagaagccagccctgcttaccccagttcccaaacacaggaagtgattttctgcctgagctttctgagttctgttccctcccaccccagggctctccatgcttattcattgcatttccttcctcattgcttttacccagtctgctgttttgggaagccctgacatgtattttggtgcctacatattttatcttctgatctcactgaaaataaaattggattttacttgttttccttgttgcttccgagctcattggagagctaaccagttctgattttaaaacagcaaaaacagccttattagctaatgttacctattcaattactaaaatcacccaaaaaaatgtttttggtcatgttagtttgctaaaaattaatcagggtcttggcctgcaggttcttctagaagagagatgctggcagggctctgtgctcaaaacttgccaaaaaactgtcttccggccagacatggcagctcacgcctataatcccagcactctaggaggcggaagtgggcaaatcacctgaggttggaagttcgagacctgcctgaccaacatggagaaaccctgtctctactaaaaatacaaaattagccagccatggtggcacatgcctgtaatcccagttaattgggaggctgaagcaggagaattgcttgaacccggggaacagaggttgcggggagccaggatcgcgccactgcactccagcctgggcaacaagagcgaaactctgtctcaaaaaagaaaaaaaaaaaaactgtcttccatggccaggcgcagtggctcacgcctctaatcccagcactttgggaggccaaggcgggcggctcacttgaggtcaggagtttgagaccagcctggccaacgtggtgaaaccctatctctactaaaaatacaaaaattagccaggcgtgttggcgtgcgcctgtagtaccagctactcaggaggctgaggcaggagaattgcttgaacctgggaggcggagcttgccctgagccaggatcgcgccactgcactccagcctgggtgacagagtgagactccaaaaaaaaaaagactgtcttgcaggaagttgaggaaacacagaattcctggttctgccgagtcagagtataccttgtgccccttgtgcctgtatctgtcccctagtgatatgaggggtggggctggagggcaattctgtgaacccacagattaccagcagcatgtgtcagtgtaagcatggagtttaattatatgcctgttttcaactttaaaggtgatcttatggccaggcatggtggcttatgcctatcatcccagcactttgggaggccaaggcaggaggatcactcaagcccaggactttgagactagcctgggcaacatagcaaaaccccatctctacaaaaatacaaaaaaattagctgggtgtggtggcatacacctgtgtaatcccagctacctgcaaggctaaggtgggagcgtcacctgagcccaggaagttgaggctacagtgagctgcgatctcgctactgtactaccgcctcggtgacagactaagaccttgtctcaaaaaaataaaaaataaaaataaatgtgatcttaaattgactgaaggcaagagtggagcccaggtcctgcctgagaggggcatgtccaattttatcatgttcatatgtaagagtttatattaacttacagaaaattaattgagcatctaaccttaaataaagttttttagctttaataatagaaatgtcactaggagttcgagcgcgatagctcacacctgtaatcccagcactataagaggcccaggcgggcggatcacctgaggtcaggagtttgagaccagcctggccaacatagtgaaaccccatctctactaaaaatacaaaaattagctgggcgtggtggtgtgcgcctgtagtcccagctactctggaggctgaggcaggagaatctcttgaactcgggaggctgaggttgcagtgagcctagatctcgccactgcagtccaggctgggtgaccaagtgagactctgtcttaaaaaatagaaaaaagtgcagctttttttaggattgaggtcaagagggaaatttcctcctcaggctcatcaagaggacattgtgtggtataaacaatgtcatcaacaacttcctggcagcattaatgttcccaacagccattaattttttttttttttttcgagacagagtcttggctctgttgcccaggccggagtgcagtggcgtgatcttggctcaccaaagcgtccacctcctgggttctagtgattctcctgcctcagcctcccaagtagctgggattacaggtgcctaccaccatgcccagctaatttttttgtatttttattagagacggggtttcaccatgttggtcaggctggtctcaaactcctgatctcagataatctacccaccttggcctcccaaagtgctaggattacaggcgtgagccaccatgcccggtgtcagtcattaatttctaatgacacttcttagagtgtcagccagggctatgaagccaacacactattcagtaaacacagttctgccgggggtcagaacagtgtgatccaggctcagctctctgctgctttggcctcatcctcgggtagattttacagtccctcatctaaggaaggggctatgttcttctagcagtcctccctaatgatttcttttactcaaatatttgggcactggaaggtttaacaagttcctggaagacatattaccaattaaagatctattcatggctgggcgcggtggctcacgcctgtaatcccagcactttgggaggccgaggcgggcggatcacaaggtcaggagatcgagaccatcctggctaacatggtgaaaccccgtctctctaaaaatacaaaaaattagccgggtgtggtggtgggcgcctgtagtcccagctactcgggaggctgaggcaagagaatggcgtgaactggggaggcggagcttgcagtgagccgagatcgcgccattgcactccagcctgggccacacagcgagactccgtctcaaaaaaaaaaaaaaaatctattcataagctcccactgcagacaaatttgagggctcttttaacaatccagttaacttgcttctagtcattggtatacacacctagggtccttattgcacgggctctgtcatctttcctgtgtctaaatacaaagtaatgcggtcataaacaccagatacatgttaatacaagaaattattatataagctccttttgaaaggagactgagctttagggaaatgtctatggtaccaataaaaaaactcattcatgcactcattacattgaatcaagcaccaggcattatggtgagtgtgggggtaattgggtaggtaccctgtttatgtcctttaaaattcccacctgacctcattttcagatgaagacacaggtagtggggacatggaacccaaatctttaaggctttgaaattctgggtgattgccacaaagattatgaggcctgacaaccagtcagaatgaaataagcctgggttggtttttttttttttttttttccatcagcttttaggttcaggggtacatgtgcaggatgtgcaggtttgctacaaaggtaaatgcgtgccatggtggtttactgcacaggtcatcccaccacctaggtattaagcccagcatccattagctattcttcctgatgctctccctccccctcccccacaggccccagggtgtgttatttccctccatgtgctcatgtgttctcttcattcagctcctgcttataagagaaaagatgcagtgtttggttttctgttcctatgttagtttgctgaggataatggcttccaattccattcatgtccctgcaaaagatatgatctcattcttttttttggctgcatagtataccatggtgtatatgtactacattttcttcatccaatctatcattgatgggcatttgggttgattctatgtctttgctattgtgaatagtgcagcattgaacatgtgtgtgcatgtatctttataatagaatgatttatattcctttgggtatattaaacctgattattaaaggctttgaggattttctagcctctttgtgttcactggaagtttaatttttataaatttcccccttcgttttcttttgtcatcatgacagggagttgagtagacattgtatgtttttcttcattgtttcagattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattggtaagagttggacagggccttcaggaaaggggtaaaccgaggacatttcagtgcttgcttttgtctctgcctactgtcctgtggtagatcagctaccaggggaacacatttgttctcgtggggttttgtcctggagagtgtagtgaagtccgagagccctagctgccaacccatggtggatggtaacttctgtctcatcaagagtaaaacagtcctgcacacagcagggtgggtttgtgcctttggcccaacaggtacatagccccataatttctgaattattctatgcacttgtttccctcttcttttattttttatttgatatatgccgagctagaatcctgtcgggtagcttttgtatactaagaacattattattattattatttttgagacggagtctcactctgtcacccaggctggagtgcagtggtgccatctcagctcactgcaagctccgcctcccgggttcacgccattctcctgcctcagcctcccgagtagctgggactacaggtgcccaccaccacacccagctaatttctttttttgtatttttagtagagacggggtttcaccgcgttagccaggatggtttcgatctcctgtcctcgtgatctgcccgccttggcctcccgaagtgctgggattacaggcgtgagccagcgcacccggccaagaacattatttttaaagaagtgttaactttgaggacatatctgttccctggagatatttgggcttgaatcaggagtttgtcctacaggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggcctgtgctcagaatgggcttagttcttataggatggatgctcagtattccttaataaagtagagttccattcttttcctgagtctgtcttttactgtgttaaaaacctgaactaggctgggcgtggtggctcacacctgta

SEQ ID NO: 1575 - DNA, 2265 bp, Homo sapiens
cgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaaaagtgtcaggagcacagaaacttgaggaagtacagcctggagccagtgtcccagtgtcctttccattggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggcctgtgctcagaatgggcttagttcttataggatggatgctcagtattccttaataaagtagagttccattcttttcctga

SEQ ID NO: 1576 - DNA, 1845 bp, Homo sapiens
atgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattga

SEQ ID NO: 1577 - DNA, 26642 bp, Mus musculus
  misc_feature (1)..(363): "n" from positions 1 thru 363  can be any base
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcatgaatgctgagactaaaggtgtgcatcacccctgcccaatttcaaaatagtgacccaagggaagaccagattacaaggtgctgcactacaaagtgagaaaatgttaacggttaccctttaaaaactttgcttagagggaaaaaaaaaaccccacaatcataaccaaagcaatggaccaggaactattttcctgcctgttttgtcttttcaaatttctgtcatcttctgctcctagagaggaacggctacagtaagatggtctgaagacctggtagttttttttttttttttttttttaagatttatttatttattatatgtaagtacatgtaagtaagtacattgtagctgtcctcagatactccagaagagggcatcagatttcgttacggatggttgtgagccaccatgtggttgctgggatttgaactcgggacctttggaaaagcagtcggtgctcttaaccactgagccatctcgccagcccagacctggtagtttaagcctgcaatctcagctgtttggggaggggaagcaggagggttgcaagctcaaagcctgagctacagaatgagttcaaagccagtgtgaataacttagcagggctcacagtcttgacattcagagatggggaagattatggggctgagctcagaccacaatataaaatgaagaaggaacacagaggagagaagccaagaactgtcggggtttatgaaatcattacaagacacaagaatttattatttttccagaattgttacccaagcatttggcatccatcgccacctacatgtcagtgtccacctggacagaaatctcaaacttagtccagcgtagaacatcttacccacaggagcgctcctcatgggactatgtcaccatcatccaactagaaacacagcagtcatctcagcctccttagtcttccttacagcagcaactccatcctctaaccaaagcatctcccactgagcacgccctcctgcccccctctctctctctccctttatcgctgctgcagtctacagcagatgcacctctcagcagggatcctggagcagccatctagtgccttatcccctccagtctttctacactccaataatgcttcaggtcactaactcctttatgtaaaaacaattaaggctcagcaagatggctcagaggggtaaaggcaacttgctgccaaacttgatgacctggggtcaatctccagtactgatgtggtaggagagactcaactaccaagagttatcctctgacctctacatgtgtgttgtggtacacccacaaacacagagagagagagagagagagagagagagagagacagacagacagacagacagacagacagacagagacacacacagagagaaatgtaacgtttagagaagaatccatccatattctttagcacagaacagaaggcacattaattataacctgggcatcctgccctgtcttcctcacatccaactctatagctgcttcctcctctaacacccaaggttgttaagtcttgtgtccccttctgtatcttgctccttgttctttggtcacacagtgaccaaagtcactgagtgttgtgcaaacctcttcttcttgactcctgtatctctctggagctctacttaggctccagtacctgcaagggattaatgccctcacatgacaggccccagacagaacccatcctctttccctctcaccaaggttgggaatgctcacagctccctgatttctgtgtaactcctgtcaagcagactgaaacaccgacattacatcttgctctttatgcttgcctatgtcccattctgtgtcatgacaattcagccaccaagttctgttaactctcccttggttatatttctctaggatacacattttcatttctatggccagaatcataaaattaccactagcccaggacctgacccatccctcacccctctttccagtatcaaagggagacaaactgtttttattaaagatgtactgtatttaaaaaaacctagaatcaaaactttgaacaaagtggggtgtgatggtatacacctttaatcccagcacttgggaggcagaggcaggtggatttctgagttcaaggccagcctggtctacaaagtgagttccaggacagccaggtctacacagagaaatcctgtctcgaaaaaaccaaccaaccaaataaataaataaataaataaataaataaataaataaatacaaggtctctggataaactccttccaaatagaaatgagaagccatctggtgaagctcagtgtgagggtgaggtggcacgagatggaactgggcaattggaaagagttaggtattgtagagccacaggagagcaggactgtggtgacttctgtggccctgtgatgttctcactcaagagtgacttacatcaggattccattcttaaataagcacactttattagcaactataactctgtatacattgtgtttgcttttaatatttaactttttgttttccaaaaagagttcctgaaacatacaacaagcagaaattgtcattgctgaaggatgcttagcatgctcatgtttctgagtgtttactaggcgtgataaatttgacttttcttgttttctttcagttcactctgtctgatgctcctgccccggtctcctaaatgcagggattataggtgtgcaccgccacacctaactgtgtacagtagatcgtaagatgggaaatcccagagtcagggaccttaggtggctgacctatacacagtgacatgcccaggaagtgttaaatctggcatttgaatccacctgtttgaccccagagtttgtcaaagggtaatagtacagcgctcttgcatgacttaaagagatgctcattttcccaagagaaccaagaggttctagtggccaaatgtcagtatgaataaatctgctgagatgcgctgtgcagcgtccgtcgaccttacaggaggacagagcaatccttttcctttttgattcatcgctcctttcagacttgatcctctcaccacagatctctttccttccacttcctcattcaaaatggggtcagttccccctcagaacaaaagaggaacatgaggcgaagaccctttgcagagggaaaatccacagctgggcgtaggccgagggagctttcgctgggagaagcaggtgagttcggatgaagggaagcaactgagagaggcaaggcagatcctcagacggggcgggttggggggggggcgactcggagagggagttttcggggagtcatcagagctggccaggaagaactaggcatgaacatgagtcccagggactccgagggacacatttctgcttaggtcccacagtattaacacggtccactaaaagcagatacgctcagcaggatgagcggccacagaggagagcctatcagtactcggtttagtcattaccttttaatacacatgatttatataagcctgtatgtgtataagacttaagttataaatggctaattacattacagaaggactacagaaggcagagagagggagggaggggagggcaagggtggggaggggagggaaaggaagatgctctttacctataaggtttatctagtatctttctaattggtccttttagtggcaattctgttaacattcaaatacaccatggagagggaagaacagaaaacccccagatgcctggaactggggaagctgtcttaaccctgacctctcttgggatgctcttctcatctataaactaatgattactttagatcacttctgaatgaccatggttaagtcctggtctaactctatccagccccgtagacctggtagacaagatggacctgtgcgtaactcttctagggctgattccacatggaatttacctacttttatttagagatgaggtctcactgtgtccctctggatgagctggaactcaccacacacaccagggtggcctcagactcagagatttacttgccagtgcttctcaaatgttggggtaaaaagcgtaagccaccacccacagaccccatgaattcatatcaattgttatttgaactaacttgaccttcctactcccctcagctcacatcctcaaccgtccctgccttcccctccagacttcctcccccatttccacgcttttgctcaagaagtctcatgatctcgttcaaggaagctctcccaggttggctgacctcatagctggcaacaaaggcaactactgctaggggtgaacacaaggctacagtgcactcatcctgcacccaaactcagaattgcaccaaagtgtgtgtgtgtgtgtgtgtgtgtgtgtgtgtgtgtgtgtgtgtgtgtgtgtgtgtgtctgtgtctgtgtctgtgtctgtgtctgtgtgtctgtgtgtctctgtgtgtgtctgtgtctgtgtttgctttcactgtgtatgcatatgtggagaccagagacgaatgaggagatcatagacatacactgtcacacccagcctttctgtggatgctggggatccaaactcaggtccccagatccatgcagcaagtcctttgcccactaggctgtctcccgagctctgcacctaggctctttataggaccagcagtgtggcctcactgtcctctatttccaatctgtgtttattacaactccgctgacatattggggttgatttcttggagggatgcttttattctcttggtgaaatatttttctgtgcactgatggcttgtgaaattttcttctctgttgcctcagttcaagccagacgaacaaggagctgagattaagcttagtaagtaaagcccaggacctggaggatctggaaactgggtgaaagagttgtcctctgttggctaggttaggttcagggcagccaggatggagtcagaggggtggctgacaacacccaggggccactgtcagctctgtgactttccctccagaaaaaggggccagttctgtgcaaacatgttcttgtccaggagtttggtttcttctctctgagcacctggcacagtggcaccaatgtgagcagtcacttggcagggcagagaaaagcaagctagcagtccccaggctcaggtgacagagccaggcccaggagacagggatattgactggggctttaacagcactattgatgccaatctcgggcaaaaacctgatatttccacttggaataacaagaaacagccaagaggattggagagaggtcagtggacaaggagagccctctgcaggtcgtgctgggtgattccagaacagaagagggcagcccctgctggacagggtctcctgagatgatggtgatggtgacggtgatggtaatagtgatggtgacagggacaatgacagtagtagtggctaggagaaggaaaaagaagaaagagaaaaacacaatgtcaggctttaaataaataatcctcatgaagtagatactatttattgtggttttgatatgaaacacccctcccccaagggctcgggtattggagatttgagccccagcgtgtggtgctattgagaggtgactttgttgatggcgactttgtttgatgaggagataagaggtggactgtaaggaggtgaaagctgtctgaggaagtaggtcaccagtggtgtgctctcaaaggtgggtctcaaccttcccaatgctgtgacgcttcatttaacacagttccttatgttgtggtggcccccccaatcataaaattagttttgttgctgcttcataactgtaattttactactgttataaatcataatgtaaatatttttggagcttagaggcttgccaaaggggtcacgacccacaggttgagaaccactgctctagaaggaagtcacctcctcttctctccttgtcattctcttttcttcctctcccttacactccccttcttctcttctctctccctactcctcacctctccactctccatgaaatctgatttcccctgctatctaccacaatgccggatctcatattcccaagaagaatggagacaaacaaccctggactggattcctcctcttttaagtgtgacttgggtgttctgttacagcaatgaaaagctagcaatataagatggctagtctcatctcttagatttaaaaaactaacattttccaaacatagtggctcatgtctgtagacacagagccagggaagcagaggcagaaggatccactgcaggtccaaggctggcctggactatgtaacaagagagagagagagagagagagagagagtagagagagagagaggagagattgaaggaaagaaagattgaagaaaagaaagatgaaagaaagaaagaaagaaagaaagattgaaggaaagaaagagagatttaaagaaagaaaaaagaaagatgaaagaaagaaaagggaagaaagattgaaggaaagaaaagaacggaaggaaggaaagaaggaaggaaggaaggagtgcagggggaggagggaagaaaagagtggagggggaggagggagaaaagaaagaaaaggagactatatgaagctatttgctcaaagccatgcatcttctatcagagagtagaatttgaactcaagtcattgcctctgaagcttgtattaccccacacacctgtcatagctcgtgagcacatttcagaaacttctagtcttctattgtgctgtttcttcctgttctttctagttatgtattcttgcagtgttaaggcttaggggattggatataaaatatcttgtgcataacaatattggcaatagtaataacaccagcttaaatttattttttatagctttagtaatttaatttatgtatatgagttcatggtagctgtcttcagacacaccagaagagggcatcagatcctattacagatggttgtgagccaccatgtggttgctgggaattgaactcaggactactggaagaacagccagtgctcttaactgctgcaaaatggtacagttactctggaagacagtttggcagtcacctgaaaaactaaacatactctttccatatgatattgcaaccatactccttggtatttaccgcacccccaaaagctgaaaacttgtctaaataaaaaccctgcacacagatgtttgtagcaactttatttggaatcggcaaaaactggaaatgaaatgactttcagtggctcaatggacaaatgaattgtggtactttcctggccgtggaccatcattcagtaccaaaatgagatgagctgtggagctaaaaaagacatgaagcaaccttaaatgcacaagtggaagaagccaatccaaggagctgcatactgtataattccaaccccatggcatcctggaaaaggcagaaccatggaaacaggtttttaaaaaatcagagattgccaaaggctaaggggagagtggatggctgggggcagcagagaggaaagcaccccacaaccatcatggcggatacacatcctcgtggccgttctgggtttacagcaagagaaaccacaccaagagaaagtcctaatgtgaactagaaaccagtgatcatgctgtgccaagttagatttgtaagtcgtaaacaagctactattctcactggagatgtctagagtagaggagactgtgtatgccaggcagaaggcatgtggaaactcttagtgccttctctcagtttatatgtgtttgtgtgtatgtatacatctttgtgtgtatgtgtgtgcatgtacacgtgcgtacacacagaagtctgaagtcgatgttttcctatatcactctccaccttagtttttcagacagggtccctcatgaaacctggaattcaccagtttgttggggctaactggccagtgagctctgggcatcctcatgtctctgccttctcagctgggattccacgtgtttgccaccacatcctgcatttacacgggtgctgagaacccaagctcaggtcctcatcagtagggcaagcacttaactgactgggccatcttcccaggctcttctcttgctgtacaattaaaagtattctttgaaaaagtctaatatgcatgcctatatttccagcaccgagtaagtggagctaacctgggctagacagtaagacccggtcttgggggtggggaacacctaacaaaaaaataaaaacaaaacaaaacaaaacaaaaaccaaaaacattaaatgaagagccagggcagtgacaagacacgtgactcctcaatctctgtccaactctggaattcaataggctactttttctgttttcctcatccataaatagaaaaagggataactgtctcacaggattgtcacagaaattaaatgagatgctgctggatggattagcagtaggagcatgtagcagcagacctgtgcaactctgtgtctttccactgatggcatcataggctactgctgggcaaggacctattcatttcataatcgcctctacctagcccagtatgtggtgtttgagccccctgagtctgctgggttgatggtaagaactagcctagacttctctctctctctgttggacatttgagggttttctcaactttttgctatgagcaaagtacatctcaaaacccttttatttacatcacctaatttgatctgcatcccaggtgaagccagcagaagagggctgtttgcccacgcccacactctgagacagacagaatcactatggctcagagaagtgaagggacctcttcgggtcacaggtatatcagtgatggtgatgacgatggcggagcctctggccctgcttctctagcccctacctctgcagacctttttctctctgcctgctgccttctgcatcagaggtctcttaaaaaattgcagccttgtcacgctgggcctggtccttctgtccgctgtctggagggcagcacctttgcccagtggtccctgctggggattgtgaactgcaaactcccagatggcctctgaaatcaaatattttatttccaatgcctctattttcccagaatgaggagcacaccagttcccccacacacacacttgctttcgtccctataaagaggtgaggagatgactctccgtgtccaggaggaaggactttggctaaaaatagctgtggcgtgtggattagccagagtggtacccaggactgggaaagggagggggacgctgtggagctgtagccagactggttgccatagaaacgagagaggagcaggggaacctgggaagtggggatgacacagataccaagtcctagtctgagctgccgttacattcaggagaaacagcagtgtcggcggctcccaatctcagagggaacctagggtactgggggagatggtgtcagggacatggacgccaacccccaagggtctctgctgctggctactcttctctccaggctctgtgagttgagttgtgggacttggggtttgggcccctatttctgagccaagaggggtttgggtggagctgctcccagagggacttctccccgacagacccctttccaaaagataagccccctgtactggccagcgctctctagagggaggtggagtactccaagataatgtggtgctcggatcttactgaaaggggtcacagcatgcccaagaactgtggtcggaagaactggagttatttggagggaagaggaagaaatgaagacgttgctcttcaggtggtggacactgcacacctttcctgtcccatgaagaagagagcttttctcgagatggcaatggctaggatgtcatcagtaggctccctgggcagtcgtgttctgggaatgatcagacactgggaatccttccccattcctggccgtagatggaggtcagatcaccttagaccctacgaagactgtctagaagcccacctgaagttaatactaggatgaaagagacctggggtctcgaggcactgaaaacttacagatgaggtgcagaggacatcctgggctgcagagagggaaaaaacaagcctgcttgctgttgggggaggggaagatcttaatctgccattgccgaagtgttcccaggtcatgtctcctgacttccatggaaaataagtgtgtggggttacaaaccatctttttggggttttttccttgtgcctttctttaacatacacacaccctccaaaggtctgctggctacagaacacttggctccaaagtttaaaaatggaatgtcgggtttgtgggtatatattcatgcagtttctccctaggatctggtcaaacatccaaaccatctgagatccttatgtcacatttctgcccccacagggccacctgctctccccacttccccagccttcctgccccacccctcaccctgaatgggaggagatggcaaatcccaggaaagagaaaggaaggttgatgagtcttaatccttattctacagacttctgttcatacggtccatatctcctaggggaccctgaaagcctaggaaccgactctggccatccatctctccgggaagattataacccagagtgcttctcaggggggaagaatttgaagcaaaaccaggtgggttttgcttggaatctgggctttgtgtggaatgtgggctttgggacatatggcaggagtgggtggggttgctggtagggtagtaaatgcaaatcaggaaattggtagggggggtcgatgtgggtgtttggtgtttcgattggtctgatttcttatctcttagaagaatacgaatctgagagatactagactagcgtaactctggatggcctggcgcctccttcatccttgccgtgggcagttgagctcacgcgtggcccccaatctcctattgcccacccttttcagcgtgtctcctgtgggaaagagccctggcgggaaatgggctggtatcagagcatcagtgaccacggtgaagcagttagaattgccagtgggaagttcccaatgctgaggacatccaacctttgcacactggaggtttttgtgcacagtctgcattgctttctccttgggaagtctggggtggaggggaaatgtagcaggagaaagagtgaggccagggagaacaccgagggaacagtcttcaggtggggcttctggcaggatgctgaagagtgctgggggaagggataattgccagggaaagggctgtggaagtcctcatcgcagggagggctttgcatggagaaggaactgccaagaagtctacctcttcagtaccctaaatgtctgatccggggtgcctgtgagttgctacatacaccagcttgaggtagtgacgctgagatctgtgacatcgagatggctaatgcctcttttcttactgaacttcgacacccagtctgtgctctttatcctgtgtaatctgtacaactctctctctctctctctctctctctctctctctctcataattctttattcttttttaaaaagatttatttacttaatgtatatgattacactgccgctgccttcagacacatcagaagagggcataagatcccattacagattgttgtaagccaccatgtggttcctgggaattgaactcagaacctctctggaagtgcaggcagcgctcttaaccccgctgagtcacctctccagccatacaactttttcttaaccattgttttattttatgtaatagtttgccctcatgtacgtctgtgcattaccctcggaggccagcagagtgcgagttacagccggttgtgagccgacttgtgggtgctgggaatcgaaatcagatccgctggaagagcaaccagtgaatcatttgagccatctccccagcacttgtgccccaactttctgagatttatgggatgttagggattatcgttcccaatccaccagtggggaaaaactaaggctaaagagacaggaagggagattgtctcacagcattggccctgagttcggggcagatccatcaactcggcacacctttattaagaccccgcaggatccccgctgcggccgccatggcgcaggagaacgccgctttctctcccgggtcggaggagccgccacgccgccgcggtcgccagcgctacgtggagaaggacggtcgctgtaacgtgcagcagggcaacgtccgcgagacctaccgctacctgaccgacctgttcaccacgctggtggacctgcagtggcgcctcagcctgctcttcttcgtgctcgcctacgcgctcacttggctcttcttcggcgccatctggtggctcatcgcctacggccgcggcgacctggagcacctggaggacaccgcgtggaccccgtgcgtcaacaacctcaacggcttcgtggccgccttcctcttctccatcgagacggagaccaccatcggctatgggcaccgcgtcatcaccgaccagtgtcccgagggcatcgtgctgctgctgctgcaggctatcctgggctccatggtgaacgctttcatggtgggctgcatgttcgtcaagatctcgcagcccaacaagcgcgccgccactctcgtcttctcctcgcacgccgtggtgtctctgcgcgacgggcgcctctgtctcatgtttcgcgtgggcgacctgcgatcctcacacatcgtcgaggcctccatccgagccaagctcatccgctcccgtcagacgctcgagggcgagttcatccctttgcaccagaccgacctcagcgtgggctttgacacgggggacgaccgcctctttctcgtctcacctctcgtcatcagccacgaaatcgatgccgccagccccttctgggaggcatcgcgccgcgccctcgagagggacgacttcgagatcgtagtcattctcgagggcatggtggaggccacgggtgcgggcaggctggaggatgggagcagggatgcaggacaagggcaagaaaagcagccaggggaggcgcagaaagatggacagagaatggagtgtagggtgacaggcctgaggggtagcgggggccggggagaggacgggagatgacagggatggacagggtgactttgcagagtcaagaaaagcttggaagaggtctatgaaatggcactagcttgaggccctgacctgacagctatgtcactttgaactacattttacatctctgaattcatttaagcccagcaaagctcccctggaggttacttttgactgtgctcggttttcagagaatgagtagccccaaagaaaggtcccataaatagcccgctgtcacaagccaataaatagcacagcctgggttgaacataggacatctatcttcagtgtttcctggtacagtgttgggatgaaggttaagtgcagggttcttgaagcccagaggtccatagctctggaatttaactgacctaagtaaaagggaggtaggtaggaaaaagactagtactggagcaaaaacaggtccttgaagaggtcctagccgtcagggagcataaggaagacgcaggtgaaccaagaggccactaggaggagctgcggagctgctacggacaggctagctccctgctgctagccttgaaacctggctcctgggcctagacaaaaacatcatcttctccatggccacctcaggtcttcccactcccctctcctccttcactccaactaggctggttctagcccatgcccattccacactgctccctctgtctctgcgctgtccctctctctgacacaatctcggacaggtttctatcagggactttttcatctgccttctcttccccctctgccactgcctccactttgcacctaaccctactcccccaagccctacctctgcttctcaggccttctccctgcagaggccccggtggcctctctttccctacgatccctgatacatcttattccagctttgccaaagaataccaatgaccccaagatgtctcagggccagacttccgatgtcagagccggtctctgattagtgaatgcttactcctctgtttttgagatggattccggtttgggaagattctgaggtaggaacaaaatgatctgccccgaggggagggtgcacaaacccaacagagaagacaggacacaggctcagggcaagaactgggaaggggcagtgtaaaggacatggggatgggagcttgcttgacttttctagagataaggctgggaaggatggtagtattttgggattcaaactgcttttgaaaagcaagaataatgagccaaaacccaacatgatgacatttaaggggaataaatataaaattctacatttaggctttaaaaaaatcacttatgtaagcacagcatggaaaggctccggtggagaaagaactgggggttttagttggccactggctttgctgcagcaacgtgatgcagcttccaaaggcgtttatgtaatgtaatcatgggcccgcttcaccaaagcatctgggcgagaagcaagagatagtaagccttcttttatgcacagataaggccacagttgaaaaagcacttcagatgagcccttacctgggcctggtggccattctgatttgcaatgaagattgtaagctttgggggagtcagatgaagtaagaaatggccatgagtgttcaatctgaggaagagaagatgtaagggaaccccatatttacactcaagggggtgtcaggtggtaagggaatggaaccaggggccacgggtcctaggagacagattttagtttatgtaagagaaaacccagagccaaagagatgtctcagcttgcaaccacgcctgactactgacctgagttgaattaccaggtctcacattggggagtcaactgtctccccaagttgtcctctgacctccacatacatacatatgcacgcatatagacacataaatgtaaaacacatttgtaaagacgattggcacgttgcacaaaggactggacttttaatgagatggtgagctttcaatcctggggtgtaatcagttcagcccattgtctgggaatgcttgggggtgggtggaggcggctctgtgggaaacaggaaggttaggcttaaggttaagcttctcaatggagagtaggggaaaacataggctggcagatagagaagagggctaactaaaaagagaggtgggactctcagagagagaagagggttgtgggatgacagacaggagaaggaatcctctgtcaggggcccctttgactgatgccgcttctcctccccccaccccccaggaatgacgtgccaagctcgaagctcgtacctggtggatgaagtgttgtggggccaccggttcacatccgtgctcaccctggaggatggtttctatgaggtggactacgccagcttccacgaaacctttgaggtgcccacaccctcgtgcagtgctcgggaactggcagaagccgcggcccgccttgatgcccatctctactggtccatccccagcaggctggatgagaaggtggaggaagaaggggctggggagggggcaggtgcgggagatggagctgacaaggagcacaatggctgcctgccacccccagagagtgagtccaaggtgtgactggtttcctcccaccccctgtggcagaccagggggccggactcaggtacacagaagctgcgagtggaggtggaagaagaggaggcaggcagtgtcccgaggaacagctaaagttgggagaggcccgctgagtccaggatcgagtagggaaggctgaggtcctggtttgaagagagagggttgcagggcggggtgagagaacatgtcagtctgtctgtgtttgaccttcacatcggttcatgggtggatggatggacagaaggatgggctcatgggggttgatcgggaaggtggagcagatagagacagccaatggataatcgctcaggtggtaagtggcttggcagtcgatgatcgtcacctgcagcacacctttgtgagaaatccatgggcatccttttcttccagatataggtagcctcaaaccagggagcgtggcttagggagcaggctgtcaggtggactaccacccccactcacctcccctcaactggcctccctatgtgtgacacgcctgcctaactagagaagagagcactgggtagaggtgggcacaggtgtgggtgccctccccagcatcactgtcccatggcgagaggtcagaaaggcaaacaagcaatgggggtagatgctgagcagggaggggccctgaagcaggacctggggacagccaaggacaactattttgtgagagaggaatgaaaccttgcaggtcctgccacagaagcaagaagcagaggaaaggccatggagagacttaataaagggttttacaagggtacctggatcccagggggaagtagtttatccttggggcacagtggcagggctcattcagaacggtgagtaagtgtcaggtgtgatattcaaagacctggttcttaacacgagagcacagcgaaggtggaggtcagaaataactcccagccactgaaggaagtatggcttcagtctggagagctcagaaaagactcgaccctaggagcccacacaagcggttatagccacaagtgagagggcattagggacaggaagctaaggattgagtaaggcagtggggaatggtgggagccagcagttacaaagctttactcacctggatgggcttgttaaaacacagattaccagccccactccctgcattctgactcagtaggtccgggacggaaaccaaaaaaaaaaaaaaaaaatctgcacgtctaactagttcccagacctaacaggttcccagatcgcggtgacactgtctgtctggggactgcacttgggtgaagcatctaagcggaagagaagctggaggaactgaaaagcaccccaggttcctcaaggaacagagaaacaagaagggaaatgttggggagaggggacccaggtccagactcgaagggcttaactctgggtccaagaaacgtcattggtaactggccagtggcacccgagagggcaacagagataggagaaggccatttagggacccccaaggaggcagtggggggtctgtagctgaattggccttaccacaaaagaccaactctcttaagagactcacaaggcaagactgactaggggagaaaatggagcctgtacctacaggtgtctgctgtctgccacctgtcctcccaggacagggcaccctggagacacattccacctccactgcatccttgtcttgccccagtcatcttgggatggttgaggggacagcaacagcatggcaatggacctgaggctggcccccctggagctaagtgtagcccaagtgagcacgtaacctgataggactggctcagactctggccctggctatacccatccctgccctcgaataaaagtctgctgctctgtcccaggctaagaagccagcatccaatggggcatcgaggcctccctcccagtgcccagctcagagtgggtccacgcagagaggactcaagctgcctgttgcctctccccttccatctagcaatggccacaggtttcgggaccagctgggtcactctcaaagatgaggtccacgcacatgaacctgctgggatcccacgaacacatattggacctgagcacagggactgagcagggtttgaattcagagaaaatcgaggagtctagacaagaggggtggggtgcttggtatccgcacacgaagcaatggaatggagacattgaagctgttcctggaggtcactcagggcaccgctgtccagggcacagccaggagacctgtgttctagcaccaatgctgattgtcactaattacctctatgactctcagcaagacctattacttctctgggcctcagcttccttatctgttaaaaaaaaatgatatgttggcaaactcaataatgctcaataaactttcaactactgaatgaaaaaaggtagactggatgccgctcaaagtattaggacagctgaggctcttaggaccggagaaccctttaggcggggagttgcggctagccagcaggcaagtcctggcatcagatgtaagcagatgaggcggctcttgtgtacacagaggacacaggctctcccaactgctgctgtccttaagtaggcagccgtgttctgaagctcctattcggctgctgtcagagaataattaagggcaggaggaaaaagactgaggccccagggcctgtgggaggagtctggtccaagactagttcaaccaggagaaatggaccagaggagggtgtgccccagtctggagagctcagaaaagactcgtcccttggagctctgtgaaaggggcaaagctcagctggaactcacccctcctcttcctaggtcccccttcccaaatagaagccccattaggacttggctcagcacagacattttggacaacagatgggaccccggcatcccctcatgcagttggtgggtaacaaggcccacgaagggacagatggtgtttatggtgggaagagaggcccgggttgtccagcaaccaccctactaccaccccacccccacccccgatgctgccttttatagcttcaccgcaagagaagacacaacaggcctcgattttacaaaaccagtttattcacattttagaaaaactagtttgaggacaggaactggccttcctacaacatgagtgtgggactaagaacggcagccaggaaacttgagggaaggtggggacaggggagccatgtctcccactctaggtgatggctggtcaaataaattaaaggtgggctggacagagggagagggtatccaggcaaccagaggaggggtggcactggctggaagacagtcaacacctgcaagaactggaaagagcatgtggagtcggctgaggaagaggctccctttgacccttaccctgctatacgatcctgcaggactgtgaagctggctgcttctccccctgatggtgcccaggtacagctcagcacaggaagcctgaggaaaggcagttcctttccctcaccttggggtgctacagatcaccgcttccgcatcctcttcataaagcagcaggtgatggtagccaggacgctggcgccggtaactagggcgactcctgtacccaccaacaggggcacaaatagggtatccacagctggcagaaaagaagacaggctctgctcagagagtaccacggtatctgacactctcccctgcagattttctagactcagccctccccaagggagagctgagcgccagtcctgcctacctacacttcacacacaaacacaaccatcccccatcccccatccccaccccctcccctcggtctcagcactcaggccggcttggggcccttcatgcaaagggatgtggaaaaaggattgcaagggaagacaggaagatggaaaggggcaaacagagcaggaacaggtgggtagatggtggctgtcactcaccatgcgtgtaggggtagactgtaacaggcccggagcgcgcactgcctgcctggtaccagctgtagtccgcatgctgcacccaggcacttggggcacagtggtatatgccttcatcctcaggccccaagccatgcagtcttagccgatgacttctgggtcccaccagctccacactgacaggaccccctccaggccggactcccagctctgccacaccgtcctgacccactccacccacaagctgagcagggccagagctcagctcgccctcctctggcctctccacccaccagctggctgctagtcgcagccctggggggccgccccgcacagagatgttgcatagcagggaggccgtctctccccggtacacagtgccccctgctagccacgccacggcctctagcaccacgcctgcagagcaaagaacacgggggttaccaggtgaaggcccaggggctaagaggttaggaaataaattctataagttctgaaccccgtcaagggctcaacatcctcttaccttcttctctcacatgcacagggagaggccgggaacgagcactggccgcttcacgaagtcgggtcccagaccctcgaacataggctttggcgaggcagcggtaggtacctgcatcagcgggcctggcagcctccagccgcagtcggtaggttctggatgctactttctccatggcaatgtgccggtcctcatagccagggcccaggctgcctataccttccgtgtctagctgggccaccaggcggccgggtccaggagcccctgcaggggccatctcccagcccacagagtacgcagcatgacggcctggtgggggcagtgcaccggacacattgcacagcagttctaagggttcgcctgggccaatccgacgttcaccaggtcccacggtcaccgccagctggctggctgaaacacagcaggagatgggaggagtcactgagatgcctgggccccccacctgtaattcttctttgcagaaatttagaggcctcttatatctccctcaccccaggacccgaatttcacccttccccccatagcctttgtatctccatgcttgtgcggcactcccgatgcccaactgagagacacccccccccccccagtgggctatgctgcactcacatagagtctgcacatcaacatgagccaggactgccctcttctctgcgacctggacccaggagccgtcaggatcctgaatccactcagcggccgtacagtggtaggtgcccgagtctccagcctgggcacccccaaccaccattcggtaccgatcagtcccttccttgctcagccgaagctccccagaagctagcctctcagcgtagggcgctccagcctccaccgccatgtcggagcgcagtcccactacttcctgtagagtggctcgccccactggcgcctccggaatggctctcccaaaggacaccgacaggtgtgtgtgtttctttgttttggtctgagccaggcagcccagcgcaagctcctgcccctcgtgcactgtgaggcgtgagggggaggtggcagcctggcgccctcggggccctggaggggcagcagatacctgcagctcatctggaagaactggagagaaaggctttagtgagagagggcttggagcagcatccctcctgtttcctgtgcgtatcctgtttcactacacactctctaggcttctagaatgtaagaactgtgctctgtagcttttcttctataccgcagagatgccaagcttggtctgggcacatcaagatattcaataactacttgctgaacgtcacagagcaagcctactgacccctactctgatgtctaagactgatccattttaaatactcaaaaaaagtaatcctgtcttccttctctaaagataaagaggctggacctgatggtgccggcctataatcgcaactacccaggaagctaaggcagaagagtcaagttcaagggccgtctgggctacagaacaagttcagtgctggtctggtcaacttggaaagtttctgattcagcccatccccccccccaaaaaaaaaaaaaaaaaactgctggaaagactggcttgatggcactggagctgacacaatactgcctgagctacacagtgaattgtgggagttttgtcaccagtttcaggccaacctaggctagttgtaagctagcctgggctacaagagtgagccctcaaaaaacaacacagggaatatagcttagtagagtgctcccttggtatgttccatgctgtaggttcaatttccagtactgagaagatgggggtggggggagaagaggagaaggaagaagatgacagagaaggaggaagacgaagcaaaaatagatctgagcgtgctggcttatacctataaccccagtgcttgtgaggctctctcaccacctagctcagagcccagtacctctcagctccaccttggcactgtagttgcccaggtactgcgtatccgtggagggggtgtagcactcataaaagccagagtcctgggcctgcaggcgagcaatcttgagcaccaccgaatctcccttcaggcgctgcacctgcaggtcaccagatgccacacgaggcccaaagacagcataggagaactggctatccttggtgctgacaatgcccagggacgtagctggggcctctggtctgtacatgaaccactcgaagtcttgctgggcagggccctcatagtcactcacgttgcaggagatagagacagcggtgccagccacccggtaaagaggtcccctggggacatgcacctgccgggcgtagcacctggttcctgtggggtaaaagcagaaagaactggaatctttttagagagaacgagtccccacttgatggccagtatcatcagcaccattcttgactgctgcctgtgaaggaaagggaaacctagggatggttagaacatagctgggcaaagacacagatgggaacacaagatgggacacgagacaccagcatcccagcacatcacgtaggttcagatccacctgaacagaggaatactctagctaactagaggcagagcacctacatgaacagaggagtccatccggagtctggggtatagacagcccggtaagtaaaatgctttccatgcaagcatcaggacctgagttcaattcccggcaactatggaaaaagcttggcacggtggctggtgagtagccacataagcctgacaacctgggtttgagccccacaagggaaggaaggaactgaatcctgaaagttgtctcctctctctctctctctctctctctctctctctctctctctctctctcacacacacacacgcacacgcacacgcacacgaataaatgcagtggacggttcctgagccatgacccctgaggttgacctctgacctttacacagacacctgcacccatgcatacatgtggaccctcatacgcatgcaattggaaataacaaataaaagaagcatgcctgattcccaactctccagctcgtggctggatctttatcgctcctaccctgccatgtgtggcgtctctccgggctcagaaagaacttctagctaagggattctgagccttttgctggaggggagctgacaacatcttacagaaaggctgcttggcttagctctgtcacctgggctagacaatggagccagtggcccaggctggctggggtactgcactggatggggcaccatgctggacagggcacggacctagtcagtcctcactacacaataccctccccactacagctgtgccatgagctcactgcttctcccagcccacaaggctacacaggcagctgtggcttctggggcaagaaccaggctctgcccaggcctggggcagaagatcccttccccgcccccagaatctgtcaaccttctcgctaacccagatgatgcactatgcacagccccccaaacaaaagctttcatttacatatgatttgcctatctgcgcagcatttgcatagacctccttttaataaggagaccccaaacacctgctgccccttcccccttctctctctctccctccctccacccattttaccccaccactgttccaacagacagccggttccaaaaccttggactgttcagcttctttctcctctccactacttctaggtaagaccgcagaaccctagaatgcaagacgggctgtcaatcattcctcagatgagagaaatgaagaaactcccagagagcacctctagggagcattgccactaggttctaaccacagatgtgagtctagagctctctcccagccaacacggaaggcctggccgtgagaaccatctctcttctagatgagaaaagtaaagtgaaatgtgacattgtggccaagtccctgccctctctggagggcctctacacacccctgaagagggacaaaaccaagaaggcggagatgcttccaaggagagccctggtttacaaaactgtaatttcccggatttccaggggtaagtccacagcttgctactggccctggaggaaaccacccaagagcctgagagcctgctctacagttctcgctcctttccttcttctggctacgtcacgcagagaacacatgaccaccgcctgaagcagaggctagagtcagaaagccaacatgagaccaaccctttcctctcctggatctcagtttctatctctcagaactaagagctcccagttctgatgttgaacccgtgagtatatgtgtgtgactcaggcacatatcgctccaggcacatttcataatcaggaggatggttaaggcagccaagctgacaccatcctggctgcccatgggtaaactctgctgagaaggtcccctcccaccttcctggctccacacaagctgatgcttggagatccccatgggaaagttgtccccacagcctcaggacataggctgctacaaggttctcaatggctgggctgcctcctttctaacagccaaaggtctgctttgaagtcagttctgagttcaaatccacccccaccctcactggatacacagtggtatttcacgacatctgtgaagtgaatgccagtgctggctgcagtgggctaaaatgacattcagctcctctcccgcccctgaataacactcactcctcccaaccacccctgggctcatccctgctcgggttaagcccaaaggaaaagaagcaatcgctaggcaaccaagccccacagctccttcaactccctacatcactctgcctcccgccttgttcccaaaggagttttcatcctggccccagaagcccaaggaaccattctgtacaacactgcacagttctggtataaaccagagaaggaggttggggtgccccactatagtatcttctccatatgcatatcacacacacacacacacacacacacacacacacacacacacacgttcctttcaagggcttcagtctcctggcaactgctccatgccatatctttcccagaccacctcctacagggagccctccaagtcagaccccaaacatggtaatgttagcaacctccacaggcctcaacacacacacactcacactcacacacacacaccagacatgacgcaaggttggcccagaaaacacaccatcataaacacccaccaggacagacactgggtgcttagagatcccaggttcagtttccatggagcctagtttctcctgaggcagggatgttgggaccaactgagtctgacaaccaggcaaatatctgggagcgtggaagggcaaagagggaactggcccagggtggagacacgtgagggaagaagcctcagatggtgacatgttatattgggaggtgggggtgttggggagacttttttcagagatcgtggtcagaatcagcccctgggcctccagccaactctgggcaattatgaagaccgccaggcactgcccacgcagagcaaacacccaaaaccaggccttgagccgagagtggggcagaaggttgtcacggtatttggtagcaacgaccccagacgctgggtgtaaccgatgagaagtggtgcctgcctccggaggcccgatggtgtctcaggggatacctcagtaggtcgcccatatgccccagctaggaacctagagcgaggacaccaccaccctccccataactgattgggcagacaggcgcaaaaggaagcgagacgccgagcccagagacagtggaggcacgtctgttggagaagtagggatgcaaccagctctgaaatgctaggaaggtgggctggtgggctgcactatgttaggcacctacccggccgggacagggacgcggcgaccaccacctggcttaccaagtattagcagcagcagcaggagcgaactcagcggcgtggggctagggacgcccattctgcgtaggcggctctggggagactcctgggggcggcgtaggctctggggggccagggccgcggggggcgcatgcccaggtggggggcagaaagcggagcagtgaagcgtgggtgcgcagagcccagccgagcgggagccgccaactccccgccctccacccttcttcccctcctccctccgctcttcccgccctccgcagctcgggagaccagtcccagccgcgccccgctgcccggccccgcccccgcctcgccccgccccaggccgtcgcctcggccagacttcgaccctgatggtggctccgcctctggcctcaggctgggcgaactggcggcacctgggctcctctatccccatttcctcgctcagagggcaccccgccctgcacctgccagccttccagggagaatggggtgctttcagggcctctggggatgcatgatggggtgactgtggttacgcactcagaatccaattggg

SEQ ID NO: 1578 - DNA, 2267 bp, Mus musculus
ctgagctgccgttacattcaggagaaacagcagtgtcggcggctcccaatctcagagggaacctagggtactgggggagatggtgtcagggacatggacgccaacccccaagggtttctgctgctggctactcttctctccaggctctacttctgttcatacggtccatatctcctaggggaccctgaaagcctaggaaccgactctggccatccatctctccgggaagattataacccagagtgcttctcaggggggaagaatttgaagcaaaaccagaccccgcaggatccccgctgcggccgccatggcgcaggagaacgccgctttctctcccgggtcggaggagccgccacgccgccgcggtcgccagcgctacgtggagaaggacggtcgctgtaacgtgcagcagggcaacgtccgcgagacctaccgctacctgaccgacctgttcaccacgctggtggacctgcagtggcgcctcagactgctcttcttcgtgctcgcctacgcgctcacttggctcttcttcggtgtcatctggtggctcatcgcctacggtcgcggcgacctggagcacctggaggacaccgcgtggaccccgtgcgtcaacaacctcaacggcttcgtggccgccttcctcttctccatcgagacggagaccaccatcggctatgggcaccgcgtcatcaccgaccagtgtcccgagggcatcgtgctgctgctgctgcaggctatcctgggctccatggtgaacgctttcatggtgggctgcatgttcgtcaagatctcgcagcccaacaagcgcgccgccactctcgtcttctcctcgcacgccgtggtgtctctgcgcgacgggcgcctctgtctcatgtttcgcgtgggcgacctgcgatcctcacacatcgtcgaggcctccatccgagccaagctcatccgctcccgtcagacgctcgagggcgagttcatccctttgcaccagaccgacctcagcgtgggctttgacacgggggacgaccgcctctttctcgtctcacctctcgtcatcagccacgaaatcgatgccgccagccccttctgggaggcatcgcgccgcgccctcgagagggacgacttcgagatcgtagtcattctcgagggcatggtggaggccacgggaatgacgtgccaagctcgaagctcgtacctggtggatgaagtgttgtggggacaccggttcacatccgtgctcaccctggaggatggtttctatgaggtggactacgccagcttccacgaaacctttgaggtgcccacaccctcgtgcagtgctcgggaactggcagaagccgcggcccgccttgatgcccatctctactggtccatccccagcaggctggatgagaaggtggaggaagaaggggctggggaggggggcaggtgcgggagatggagctgacaaggagcacaatggctgccacccccagagagtgagtccaaggtgtgactggtttcctcccaccccctgtggcagaccagggggccggactcaggtacacagaagctgcgagtggaggtggaagaagaggaggcaggcagtgtcccgaggaacagctaaagttgggagaggcccgctgagtccaggatcgagtagggaaggctgaggtcctggtttgaagagagagggttgcagggcggggtgagagaacatgtcagtctgtctgtgtttgaccttcacatcggttcatgggtggatggatggacagaaggatgggctcatgggggttgatcgggaaggtggagcagatagagacagccaatggataatcgctcaggtggtaagtggcttggcagtcgatgatcgtcacctgcagcacacctttgtgagaaatccatgggcatccttttcttccagatataggtagcctcaaaccagggagcgtggcttagggagcaggctgtcaggtggactaccacccccactcacctcccctcaactggcctccctgatgtgtgacacgcctgcctaactagagaagagagcactgggtagaggtggacacaggtgtggctgccctccccagtatcactgtcccatggcgagaggtcagaaaggcaaacaaacaatgggggtagatgctgagcagggaggggccctgaagcaggacctggggacagccaaggacaactattttgtgagagaggaatgaaaccttgcaggtcctgccacagaagcaagaagcagaggaaaggccatggagagacttaataaagggttttacaaggga

SEQ ID NO: 1579 - DNA, 1131 bp, Mus musculus
atggcgcaggagaacgccgctttctctcccgggtcggaggagccgccacgccgccgcggtcgccagcgctacgtggagaaggacggtcgctgtaacgtgcagcagggcaacgtccgcgagacctaccgctacctgaccgacctgttcaccacgctggtggacctgcagtggcgcctcagactgctcttcttcgtgctcgcctacgcgctcacttggctcttcttcggtgtcatctggtggctcatcgcctacggtcgcggcgacctggagcacctggaggacaccgcgtggaccccgtgcgtcaacaacctcaacggcttcgtggccgccttcctcttctccatcgagacggagaccaccatcggctatgggcaccgcgtcatcaccgaccagtgtcccgagggcatcgtgctgctgctgctgcaggctatcctgggctccatggtgaacgctttcatggtgggctgcatgttcgtcaagatctcgcagcccaacaagcgcgccgccactctcgtcttctcctcgcacgccgtggtgtctctgcgcgacgggcgcctctgtctcatgtttcgcgtgggcgacctgcgatcctcacacatcgtcgaggcctccatccgagccaagctcatccgctcccgtcagacgctcgagggcgagttcatccctttgcaccagaccgacctcagcgtgggctttgacacgggggacgaccgcctctttctcgtctcacctctcgtcatcagccacgaaatcgatgccgccagccccttctgggaggcatcgcgccgcgccctcgagagggacgacttcgagatcgtagtcattctcgagggcatggtggaggccacgggaatgacgtgccaagctcgaagctcgtacctggtggatgaagtgttgtggggacaccggttcacatccgtgctcaccctggaggatggtttctatgaggtggactacgccagcttccacgaaacctttgaggtgcccacaccctcgtgcagtgctcgggaactggcagaagccgcggcccgccttgatgcccatctctactggtccatccccagcaggctggatgagaaggtggaggaagaaggggctggggaggggggcaggtgcgggagatggagctga

SEQ ID NO: 1580 - DNA, 27684 bp, Homo sapiens
ggagtaggagaaagctatggcattttaggaaaattaatcgggaggtgacaaaatagtttgaaccaagtggatatagtaggcaagtagacgatagaaaataattgcaataatataagcatgaagagatgacagcccaaatcagcgtggcaatggtgaaaagtggaacacagaaaatgaattggagtacagaaaaatcaaaagaaaatgaaaaaagtttgaagccaacttgacatgttgagcaaaagagggaagcttcagagatcatactagagtctcaagtcaggtgatcagaactgcgaggtcattcacgggcataggggagcctgggggggatcacacctggtgaggagactgaggtgggggaagaggaagtgatgagttcagagctggaagctgtggagaggggtcagaaccagagagagaaaggaggtcattgctgccagggcagtgtgagttgaagctatgagaacagggtagatcccaacaaagactgcacagagaaatgagagcctggcacagagagtgaggaacacctatgtttaggggatgggaagaagaaggacccccaaagagtgaaagagaatccaccagacaggcaggaaggagacaaagaaagtgagatgtcatggagctaaggaaggagagactgttaaggaggaggttctaacagtgccaacaagtacagagagaagaggcattgggtttggcagtgacaaagtctctagtgacatttgagagcaatttcagaagagtgagcaaggtgggaaccagattacaagttaccactagaaagtgagaaactgtcagcaagtataggttacacttttgagaactctactcatagagaggagagaaatagaaaccagacaatgtactagaaacaggccaggccaggtggctcatgcctgtaatcccagcactttgggaggccaaggtgggtggatcacctgaggtcaggagtttgagaccagcctggccaacatggcaaaaacccatctctactaaaaatacaaaaattagccgggcctggtggcacgcgcctgtaatcccagctacttgggagactgaggcatgtgaatcgcttgaacctgggaggcagaggttgcagtgagccgagatcacgccactgcactccagcctgggggacagagctagactctgtctccaaaaacaaaacaaaacaaaacacaaaataaaaagaaaaagaaacagtcttccagtttttcttcttcacactccgaatgccctctcttcctaagtcaatatggatgaggggctgtggtgaggtggtctgagggccagcctgcaagactggtataagacctttaagtttcaaaaaataggacatccaaaagatccttaagggggccacagtcttgacattcacagacagagaggacttaggcaggggtgtccaattttttggtttccctgggccacattggaagaagaagaattgtcttgggccacacataaaatacactaacactaacagtagctgatgagctttaaaaaaaaaaaatcacaaaaaaaaccctcatgatgttttaagaaagtttacaaatttgtgttgggcctcattcaaagctgtcctgggctgcatgcagcccacaggcggtgggttggacaagcttagcttggaggctctggtggaactccaaaataaacatgaagaacaccacagaagagaaagcaaagggactgtaatgatttatggatcattaacagacatttattgtgcacttattatttttccaaaaatgttatccatccatttagcttcaactaccacccatgtgtcaatatgtccagcccacccggatatccatttcaaactcaacatatttaaagtcgaacatgtcaccttgctcacaagagtgctcctctccatttattctctaccatggtagatacactatcatcacccaaccagaaacatggcagccatcctagattcttcaatcttcctcacctcatctcccttattgaatcaatgcatctgtattctaaatagcctcaatattgtccccttcctctctattccactatcattgctgtagtctaggacaccattacctctcaccaggtaataatagtttggatctttgatcctgctcaaatttcatgctggattttaatgccaatgctggacatgggcctggtgggaggtgttttgatcatgggggcaggtccctcagcggcttggtgctatcttcatgatagtgagttcttgtgagatctgggtgtttaaaagtatatggcaacatcccccatcatcaactctctcttgctcctgcttttgccatgtgatgtgcctgctcctgctttgccttccaccacgagtaaaagcttcctgaggtctcctgagaagctgagcagatgtcagcaccatgcttcctgtaaatcctgcagaactgtgtgccaattaaaccttttttctttataaattacccactctctgggtttttttttttttaatttttaatcttttttttttttttgagacagggtttcactctgtcccctaagctggagtgcagtggtgtgatcacagctcacttgtacccctgaactcctgtgctgaagtagtcttcctgcctcaacctcaaacgtagctggaactacaggtgttcaccattacacccagctatttttttttttttttaactttcagtagagacgaagaatcgctatgtagatcaggatggtcttgaacttgtgagctcaagcagtcctcccacctcagcctcccaaaatgctggattacaggcttgagccaccatggcctatctcaggtatttcattatagcaatgcaagaatggcctaatacaccagggctactgcagcagccttctaactactctccctgcctccagtcttcctccactctaataattctttggattatgaatttctttatttgaaagtaattaagcaccagtaaagtacatctctctgaaacacacatctgaccgtaccacttccaagttttaaaaccttcagtaactgccaactatctataagtaaagtccgagttcctttccctggaagagaaggcctattataacctggacctggtgccattccagccttatcttcttccactgcccctatacacccaaagctacagctacttcttttaacactcaaggttcagccttatgttctctttctgtgtcttgccccttgagcctttgtcatttacatagctccaacgattgtccctgagtgatgcccaaatctctatcttcaatcctacactctctttggagctccatatttctagttgcttgcaggggatttccatcttgacttgacaggccccaaactgaactcagtaccttcctccccaaaggtggaagtgctcgtgacttccttagttctgtgttactcctggtcaattagaataaaaaactacaagtgacctttactcttcaccgttgccttgggcccattcctggacatgtcaaataagccaacaaatgctgtcaagtctccctttctttcatctgtttgcaatgtgctttttcattcctatgaccactatcagaatcagaaagatcaggacctgacccatccttcacctttctctccagtctcaaaggaagaggcaacctgttttcatcatgtcggtccctgtgcccttgttttaaaaccccaaacagttgcctcgtgcttacaggtcacagtgaaggaggtcttcaccacagaagacctagaaaaaaaaaaaagaagataaaaaacgtgacaggccctcagactgaactcggcatctttctctctgaggctggaagtgctcatgacttccttaattctatgttacttctggtcaatcagactaaaaaactacaagtgatctacagaagtgtcctctactaacaatcagagtgaggatagagtcgggtgggactgggcagttagaaagactttataagtccttgaacagcaggggtgggagcttgtggaaaagtacacaggtagcttcaacagcactgtaatgttctgaatttaaaagagtgacttaaattgagtttttgttcttaaattatgctttataacatatagacatatgtccaccatctatattcttttgtacatatcaaatgtcaggttttcatttttaaatttgtttgcaaaagagaagtcctaggacagtctctaggagcccagtagggaatcagtaataaggggcataggacactaatatttgtgagtgtttactacatcagatagatcagaagatggggaaactgaagttctgaggagttaagtggtttgcctatggtaacatagctggaaagtgttttgagatttgaatccacatatatttgaccccaaagcttgtctcagaataatgccagagggaatttgcacgttttaaacacaatcttgccaaccagaggctatgacccctgagtacatgttggtatgaaaaattccccagaattacaacatccaatgtccaccatgaaacatgacagaggaaacttctctttttgaagacccctctctcttctttcagtttcccaacttgcgtcttccttattctcctccatttctcctttcagactcactgcttccagctttggcctcatctctacttttacttcatttgtaatggggcagaggctacctcagagcagaggaggaggagagttggggcgtgtcacctgttttagaaagaatccacaagtgggcagcagtctgaggggcttgcgctgggcaaagcagatgtggacagagggaatcaggaaagctttgggttgggaggcatgatagagactcagaatagtcagtatttaacaagtcaggggaagtggctagaaagaacagagacactggcatggctcaccacaggattcaggattccaagtggcgttttggtgctcacatcccacagtgcggaacaaattccattagtagtggagcatctcatagctgaatgactcaggccgcagaggagaaatccaagagaaggactgagctacattcccctagtcactaacgaatcattatgtaagtagatcaccccctttaaataaatgcaatatacacaaacccacatttataagacataatttagggaatacttagttacctactaaagaattctttcctttaaaaaagaaaaacatggccaggcacggtggctcatgcctgtaatcccagcactttgggaagccaaggtgggtggatcacctaaggtcaggagttcaagaccagcctggccaacatggtgaaaccccatctctactgaaaatacaaaaaaaaaaaaaaaattagccaggcatagtggtgtgtgcctgtaatctcagctactcaggagggcgaggcaagagaatcacttgaatccgggcggtgggggttgcagtgagcggagatcgcgccactgcactccagcctgggcaacagagcggaactctgtctcaaaaaggaataaaaaaaaaggaaaaaagaaaaaaacaaatttctctaactagggacttctagtacctttccagttgggtccaattgatagaaattccattaacatccaatgcactgtgataggagggaggcaactgggaataaagaaacacgaggaatctcgagtcgggtggcctgagtcttagtcctgactatgttcttgggacctattcctacctgtaaagtaagggctaatcctgtaccacctctaaccgtcatataacttttaaatcttagcctatctctacccagtcctataaagcaagatagaactctgtgtgaaggcttctgatcctcctgctctgctgaaagtagccagaaaggcagcaagctcctcagcctcaggaacccagcctgaggcgaggggctggctgaaattgcctccgtctggcctggagctgtgctctgcttctccccatttcactctaatcttcagcttcagtcatttgccacatctactccttcaaccatatctttcctctgctctgagttttctagagccccatcccccttgaatttatacaaatttttgcaatcaaccagattggcctccctgctccactaaactcatatcctcaactgtctgctgtcttccccatcatgcttcctcttccacttgccagattttgcacaagatgtctcatgatcttgtccagggaagcctccccagtttggctgatctcagggctgccacaaaggcacctgctgatggggcaagttgaggactgaactgcattcagcttgccaattcctgcacccagctcagagctgtgtctgctggaggaagggaaccttttattttctcccaaaagtatcacctgttccctgttctccaagtgacaggccacagtaggctctttttaagctcttttcctattttgcaccacggttcccttttttttttttttttttttttttttttttttatgagacaaggtctcactctgttgtccaggctggagtgcagtggcgcaatcacggctcactgcagccttgagctcccaggctcaggtgatcctcccacctcaacctccaaggtggctgggaccacatgcacataccactacacccatctaattttgtattttttgtagagacagggtttcgccatgttgcccaggctggtctccatctcctgggttcaagcgatccgtgcacctcagcctcccaaagtgctgggattataggttcgagccaccgtgccaagccaaaagctagaatcttgtctatgcttttgtgtcctggtgcctgggaaaactttttttctcctgcctcagttcagctcagtgataaataaggaactgaggttagataacaggtaaagtctaggacctgcaggatgagtgaatcaggtgagggagtggtagtcttcttccttgtcagccaggctaggttcaggggcacctggactgaggcgaggggctggctgaaattgccttgtggagggccctgccagtgatgccccctccagcaaatagggccagctctatgcaaatgtgttcttgcccaggagtttggtttcttctctctgagctcctggcacagtggaaccaatgtgagcagctgcttggcaggacagagaagggcaggctagcagtcccaaagctcgggtgacaggaccaggcccaggagacggggatgttgactggggctttaacagcactcttgatgccaatctcgggctgaaaactcgatatttccacttggaacaacaagaatcaccagcaagagagctgaggagagggcagtataccgggggcgccccctgcaggcctcacagggtggtgccagaacagaggaaggtggcacaggcagggtggggctttcaggacatccctgagatgatggtgatgacggtgacaatgatgatgaccatgaagaagacaatgaggaggaggaagaggaagacagtagctagcatttactgagtactaacaatgtgtcaggcattgccttatgtagtcttcatgacaaccctctaagagatgaataatatggttttcttttttttagatgaagaatctgaggtttaacgggttaaataattgctcaggttcacccagctagtagtggacagaggtgggatttgaacccaagtcattgcctcctgagcttatattatccagtaccgaatttcccaccttgccaggtcattccaggagcttctagccctccgtgtccatctctatgtcttcctgctcctctagctcatattttcttgatccaaatttaaaggatctggataagaatagatccatatctgggatataataatactgataacaacagcaacaacactttgcgtttgtaaaccactttcttctcttcattatttccctggggaaaaataaacaataagatatttctgtttctccaaattttgttctgatttttatcagtgttcctgaagctatttcaatatagtcatgatcaatttctaagaatatttttaggttctgcttttttatgtaacagtgtgttatatacacattcacatatttaaacacagcaattattatggctttacagtaacccatgatattaatattccacagatattacattactgaggcacactaggctaaggctgacaacaccaaatgctggcaggaatgtggagcaacaggaacaggaattcgtggctgatgggaatgcaaaatggtacagctactttggaagaaagtgtggcagtttcctaaaaaactaaacatactcttaccatacgatccaggaatcatgctccttggtatctacccaaaggagatgaaaacttacgtccacatgaaaatctgccgatggatgtttatagcagctgtattcatcatggccaaatcttgaaagcaaccgagatgtccttcagtaggtaaatagataaataaaccatggccatcctgaaatggaatattattcagtgccaaaaagaaatgaactacaaagccatgaaaagacatggaggaaccttaaatttacattactaagtgaaagaagccaatttgaaatggctacatattgtacaattccaacgacatgacattctggaaaaggaaaattatggaaacaggaaaaagagcagttgttgccaggggttagggaagggggattgactaggcagagcatagaggacttttacagcaatgagactataatggtggatacacatcattatatatttgtccaaacccacagagtgtacaacaccaaaagtgaaccctaatgtcagctatggactttgggcgattatgatgtcaatgtagcttcatcacttgtaacaaatgtgccattctggtggatgtgtggggacagggggcatacggaaaatctctataactttcctctcagttttgctctgaatctaaaactaccctttaagaagtcttcttttaaaacaatttacaaagcatgaggtgatacagatgtgggagtttggctcctgtctctgcccaactctgtgacattcgataaattacttaacatgtctctgtttcagtttcctcatctataactgggaaaaataacacctgtcttatagagttgccatggggatgacatgaggcatgtgtctcgttcatatcccatgctcagtgaattagtagcagcagccactgtgtgtttgtgtgtctttatccctcctgggttaatgagctccttgtgggcagggactcacccattctgtaaccaccccatctaacacactgcctggcacttgggctccgcagaagtttgccgagtgaatacttagtaagccctaacctaggcttttctctctggtggacatttgggttgtttctagggtttttgctatgaataaaacacatttcaaagccctttgtggtttttttggtttttgtttgtttgttttttcttcgtttgatctgctgactctgtgaagcaggcagaaaggggatatttgctcttgtccacaccctggtacagatggaataactgtggctcagggaagtgaagtgactcctatgggacacagtgcaaatcagtggcaataattagaacccctgaccctgcctcccttcctttagtagatctattttccttctagctaccgccttctggatccatggcctctccaaaactagaccatgatggtcagcctgacctgagagcagcacctgcacgcagagacccatgttgaaggtggtgagctgccagctaccagatggccctctgaaaccccagggaacctagcaccttattctcaaatacatgagggcttgtattttcccccaggaaggagcttcttaggaaagagccagcgtgccagctttgtttttctttcttcttctttttttttttttcctatgagggggtgaggagccaagctctgagttgtccaggaggagggactttggctaaaaatagctatggcgtgtggtttggatcaacccctagtggtacccaggactggggaggggagggggatgctctggagctgtcgccagactggttgccgtggaaacaagagaggagcaggggagcctgggaagtagggatgacacagatagcaagtcctagtcagagctgccgctacatttaggagaaacagcggtgtctgcggctcccacccttcggggggcccgtggggggggcggtgtcaggggcatggacgccaccccccaggggtctctgctgccggctactctcctctccacgtgctgtgagttgagttgcgggggacttggggtttgggcccctatttccaaggcaagtgggggtttgggaggagctggttcttgggggagttttcaccaggtctctccttccaaaaaatgagcccccttactccccagctctctagagggaggaagaggggcccaggaaaagtggtattgcaatcttctgcaaaggggtcatagcatgcacaagaaatgaggagtaggttggaggaactgaaattcttggagggaagatggagaaatcaagtccttgatcttgagatagaggtaacaatttcacacttttccttcccctgagaaaagtgcagtcccccactcaggaagacaggatgtgggacacattcaaaataaggtttacctagatccctggggcaatggagagtgagagagttctgggggtgatccgacatcggggttccttccccatccctgggcagagagatctgtctaggcaagccgactgggggtcagattacctaagaccctgagagaacatctggaagcccacctgggactaaagctaggataatgggagcagggtcgttttctgcatgacctggggtctctgagccagtcaatgcttactcttcctgaggacatctgagcttcaggaaaggaaaaggaagcccattgttgggggcaggggaaaccctaatcttccattgccatggggctcttggaccctgtgtcccctgactccatggacaataaatgcagggggtgcccctaagctcaaagccatttcattttgatttctcttcctaccttctctaccccaagacacacaaacacacacacacacaccctctccagagtgctgactgcagaggacctcaccccagaacataagatgctggagtgctaggtttagagtcacatacccaggcagtttctccccaggacctggtcaaccatccaggccatctgtggttcctatggcacactcctccatcccccacccactagccagcccacgtttccgtggagtgggaggagaggatcattcccaggaaagagaagggaaggtggaagagtcccaaatcctattctaaacctttccctgtatggtccatatctcctagaggaccctgggtgctttggggaagggctctggacctctctcagagcagattgcagctcagagagctcctcagaggcaagcatgtgaagaaaaatcaggtgggcttcgcttggaatgtgggctttggggcatatggcaggtgggggcggggctggtgttaggatagtccatgggaagtaagaggctgggggaaaatataactagagggagtggggaaataaatgtgggtgcttagtgcttcacctgatctgattccatgtctctcatgaagaataggatcccagagggatacgagcctaactctttataactctgggcttcctttcccaggcttctgtgttgggatcttccagttcccctccccatttgcaggctgtctccactaggagaaaaaacccaagggaaatgaggctggcccaagagcagcagtgatcgtgggtaggtctcagggaggatttctagtgggaatttcctaatgttccacccttgtgcactggagggtttccactgactttccacagctttcatttctttctcgtttgtaagcatgttgaggggagggaatggagcggagtgagtgaggtccaaggagggaagaatgagaaagactgtgtatcagtcttggggtgaacttcaaaacagcctgcgaggagagccattggtggctgcactggctacagctggggaagggatggtggaagtccttagggcagggagggctccattacccgcctgcccccctccccaaaaagcccccagtctattgatttcaggaaatcactagggggatctgggcctgggtctttggccccggggctgcccctgaggtgctgcacaccccagctggaggtgatggcaccaaaatatctggtacctccttcccctgaaaatcatcgtggaacttgcacagttctatccagttcaggtacatcattccatttgaccctcacaactttctgagcctggggggcagttagggctgaatgtgttattcccagaaatagaggccaggcaacacgaagggactcgcccagggccccccagggctcggtgctggccctgatgccccgtgcctccccatctcccgaggggccactcattcggcaaacctttattaagcccctccaggacccccgacgccgcctaggcgcccagcgacgcgcggcaggtggcagcagctcgggcccccgccgcactccaggcgcccgcagcgctcgccctgacgcggccgccatggcgcaggagaacgcggccttctcgcccgggcaggaggagccgccgcggcgccgcggccgccagcgctacgtggagaaggatggccggtgcaacgtgcagcagggcaacgtgcgcgagacataccgctacctgacggacctgttcaccacgctggtggacctgcagtggcgcctcagcctgttgttcttcgtcctggcctacgcgctcacctggctcttcttcggcgccatctggtggctgatcgcctacggccgcggcgacctggagcacctggaggacaccgcgtggacgccgtgcgtcaacaacctcaacggcttcgtggccgccttcctcttctccatcgagaccgagaccaccatcggctacgggcaccgcgtcatcaccgaccagtgccccgagggcatcgtgctgctgctgctgcaggccatcctgggctccatggtgaacgccttcatggtgggctgcatgttcgtcaagatctcgcagcccaacaagcgcgcagccacgctcgtcttctcctcgcacgccgtggtgtcgctgcgcgacgggcgcctctgcctcatgttccgcgtgggcgacttgcgctcctcacacatagtggaggcctccatccgcgccaagctcatccgctcgcgccagacgctggagggcgagttcatcccgctgcaccagaccgacctcagcgtgggcttcgacacgggagacgaccgcctcttcctcgtctcgccgctggttatcagccacgagatcgacgccgccagccccttctgggaggcgtcgcgccgtgccctcgagagggacgacttcgagatcgtcgttatcctcgagggcatggtggaagccacgggtgcgagcaggcctggggaggggagcggggttggcagagggtgggcgggaccgaggaaggcaggggcgagactaggggccaggggagctggggaggatggatggaggggctggtggaggatgagacagtgaggtgagacaggggtcggaggcgggagtggaaccgagcaacgccgcagaaggccaagagaaagcttggaggaattctccgaaatggcactggcgtggggccctgggcccagaggaatgtgtcacttggaatagggacagtaataatagctagtgctcgcccagtattcaccctgtgtcatgcgcagttccaaagcactttctacctctgagtcgatttaatcctaacaagaaccctctgaaggtaacttcttgttattgtgctcactttttagagatgagattgctccaatgagaaattaaggaagttgtccactttcctaagccaataagtggccatgcctggattggacacaggcaatgtggcttcaatgtttagtggtcccgagttggaaggaggggttaggttcaggggttttctcactgcagtcaggttcaggcccctggaatttgacggtgaaggttttccattgcctgagttatttctaggccggatcttgaggggagtttaatacctagtctcacttgtacctcggtttcccaattcatccatttccactgacaagggatatagatgatgttaccttttctagctcttttccaaaaggaactggcaactcatctgtgatgtcaataagtccaacccagacctacacagtgaaggctttgggagcaggtgaaaaaagaccagtgttacaggagtcgcaaaggaggtcacttaggacttgagatctagaggatagatgaggatgaggaaactgcgggtggaggaccaaaggcccactagggggcgccgcagtccctcctctgacgccagagctgctgatgctccctgccggcttcgctgacaagctggtgccttcagatcctttccctggcccctttaggctgagactccgcttcacaccccaaccccagctccgcatcactgttcccattcctgcttcaccccgactctttcctcttcccccactcaccccgttccctttcctctctctccagctgtcactccttttctgccagtatctcaggcaggcccctcaccctccagggaagttgctgcccggccctcttttctctttgtacccccagccctgccctctcctcctcgaagcccttctctccccagtgtcccttatgcctctttctcttctctcccactggatactttctattccaacttcaccgaggaataccaatgtctcagcgccaggctttccgagttgacagccactctccggttagctaatgttcactcttctgtttccccttgttccgagatggatatgggttgggggcaagaccctgtggcagaaaggagaatgacctgccctgaggggtgcaccagcccaacaggaagataggacacaagccccgggcagggaggaccaggacagaggagatgaggataggaatctgtctgtttttctagagagataaagctggaaaggatggtaatattttgggtgagacagtcaggattcaaaacgcttttgaaaagcaagaataatgagccaaaacccagcaagatgacatttaaaatgaataaatataaaattctacatttaggctttaaaaaaatcacttatgtaagcacagcatggaagagcactggtgaaaaaagaactgggagttttagttggctacagtcttgatgtcgtagcaatgtgatgcagcctccaaaatgattatgtaatgttatcctgggccctattagtgaaagcatcatggccagaagagagagatggtgcgcgctctcttatgcacggagcaggccacagttggaaaatttactatactcaaaatgcttaaagggccctccttggccattctggcttgtaatcaaaaaagtagagttctggaaaaccaggtcaaatgaggaatcgtggaggaagccagggatgttaagtcaagagagaaaacatgagggaatctgagactcctgttttcagatactcagaggactgtgaagtgggaggggaatgaagccaagagttggaaatcccagggtacaggttttagctctgtataaagaacaacccaactattagagctatcatacaaaggagtgggccctttatgaagtggtgagctatcaatcctgggaggtaatcaagtataagctagatgcccattgttagaaatgctcctttggggagccctgtatggagtgagaagttggactagaggatccctaaggttagtttcaaggttaagctttttttggttggcatcaccaaatgacaggaggggaaaaaagagctggacattaagaggagttggggcaaatggagaagacacgagggagctgggtaagaacaggagctagggagggggggaaatggactggaccaaagggaggtgggagcccttaggaaggaatagaagggagggtgctgggagtagggttgtggaatgagaagaggagagggaagcctggagctgagattccccctgaccggtgcccctcctcccaggaatgacatgccaagctcggagctcctacctggtagacgaggtgctgtggggccaccgcttcacgtcagtgctgactctggaggacggcttctacgaagtggactatgccagctttcacgagacttttgaggtgcccacaccttcgtgcagtgctcgagagctggcagaggctgccgcccgccttgatgcccatctctactggtccatccccagccggctggatgagaaggtggaggaggagggggcgggggagggggcgggtggggaagctggggctgacaaggagcagaatggctgcctgccacccccagagagtgagtccaaggtgtgaccagcttcctccagacccctgtggcagaccgggggccagacacagatacatggggaactgcatatcggaggtggtggaggaggaggaggaggaggaaggcaaagcccctggaaatgtgctaaagttggaaagtccccgtcccccagaacctcaagtctagaaaccagtatggaagggaggggtcctgatttcagggaaatggagggtggggccgggtgaaaatgccagtctgtgtttgaccttcacatttgttcatgagtggatggatggacagaatgatggacttttgggggttggatgggaagatggtagcagataaagacagctgacagatacatagatggaccagtagacaactggtccactcagggctgccactaacctgtagaacacccctgtgcaaattttaaaaaggaacccttttcctccagacagatacagccccaaaccagggtgcatggcttggggagcagagtataggatggattgcagtccccagtcacctcttctgccagcctccccacatatggcacaactgtctaatgacacggtaggccaagctgaagtgaaggagaaaggagccggaccaagatgggcacatgaggagggtgccctcctagctccaccctcaccaggatgaaggcgtgcaaggggctcagcaaggtgtgaatgaccttagtccgcaagttcagggaagcaggcagagcggggaggtgcctgagctggggcctggagaggggcctgggaaaggaaaaccagggatagctattttcttacagtggagtgagatcttacaggtatcaggcacaggcaggaagagagagagagaggttctggggaggaagggccaggagagagatctagaaagtgggttcactagagctgggaaacagggagcccctaggaaagcagtgtgtccttggggcacagtcattcacatcactgattgggtgccatgtggagtggacattcaaaaacctggttcctgtcctcaaaataaggggcacctgggaaaacagaggaatctacctgtggtgactgaacgagggataattcaaactgacaacctgtgcagtcccgtggagggtaggggagtgtgggtgatcagaaggctggggccagtgtaaggcatagggaatatgtaagtcaggagttagaaatctccagtgtgcgttggaatcacctggagggcttggtaaaacacagatttttgggctccactccaagggtttctgacccaagaggtggggaccaaaaccatgcattcctaagaagtccccaggtcatgctgctgttgctggactgaggaccacactttgagaacctgtgctctaagtgaatacttggaagtcgtttcaggacatggggcatagaaactgaggagtagctgagaggaagatgaagagaagctgagaagaagctgaggatcctcacaggagcagacagagaaatgtgaagggtggggttttatgtgtgggaaagggacccgaagcccaggctgaagagtttaactttgggcccagaaactcaaccatcaatggaaacagggcagtgacaagtggagggggtgtctggaagctgagcaggcccgacagagagatgaagccatcagaaggacttgagggggctcctggggaggtcggggggaggtggagcaggaagagttttaggggcaaaggacagaaccccttgtaggactggaggcaagattgaatgtgggagaaaatcggagagaagcgataggagttagaacatctggatgtgtctgcagcctgctgtcagcccaattgggccagggggtcccaaagacgcatattctcaccccacctccacctgcttcctgatcacatcccagtcaccagcggcagcttcctggatagtgagggagaacaactgcaagttgagagaggcagaggggtggaagggacctgaagctggcctggagaaaagcataggcccaggagagcctgccctgggacagcgcctgtctcccacacagcagcactggcccagcaaggacctcctcccttggccctggccacatcccactcctgccctttcataagccccctggggaaagcactccagtcttctctgttccaggctgggcagatagggtcctatggggcacagccagggtcctatgggcatagccagggccctatgggtcctctggaagcaagaaagggggccatggaagcagcccagacagctggggttcactcagagaggacccaagtcccagtcccttcctttcagtcaaaacacggatatctttgcctcaggtcacagggccactggggccctgtcatcaaagatgagattcctgaagcctggcattgactggtcccctaagaacagatgttgggatggagaatggggattcatttgggtttcagtaaaacaggggggtctggacaagagcgggtgggctacttggtatccacacacacgcactcacacaggagccaacccattgcagctgaacaagcagagaaactcagtctggaaaggcccctcctgcctgctgaagtcactgagaccctgccacacctctcctcgccactgtcaccactcagggcaccactgtacagtgcaacaagtcaggagacctaggtcctactcctgacacttgctaattagctctatgactctgggcaaatcgcatatctgggcctcagtttcctcatctgtaaaaatgacagcaaactcgtaatgctcaataaatgtttaaataacaactgaaggaggcctgccagatgcctcttaaggtgccgtgcaggtaagaattttaggatcagagaatccttaggcaagaaaattcatgaaactcctggggcactggaggaggggtgaagctgaagggtgggagggaggagaccccagggtaggtacaggcaggtgaagcgggtatatgcaggtgtagtgggtatatgcgggtagagggtatatgcaggtacagcgagtacatgtgggtgcaatggctctgtggacacacaggccctcccctgactgcctgttgtcccagcctgagtatcagttgtgttctgaggcttctattctgctgctatgggtcagaaggaacaacaatttcagccccagggcctagtgggaggagtcaggtccaagactagcctgaccaggagaatgagacgtgggaagagttggggaaagtctgggaagctcagaaaaggcactgcccctggaggcccatgccctttaacatgggagaagctggtgcgggggtgaccacaggcagctggaacctaccctccttttctatgcttccctccccaagtaggagtccaatcaggagttgtctcagccccgacagttcaggctgcagatggaacccaggtgtcccctcctggggtgggtggcatggcccatggaggccagatggtgtttgtggtgggaagagaggcctgggtcatccagaataggttgtcaatccccaaccacctccctactatgcaccctgagcgttttacagtctcatggtagggaagacacagccaagcctgctttttataaaacaagtttattcacattttagaaaaactaattccaggacaggaaatggcctccctataggatccctaagagatcaagaacagaaggccagagggaggggcttgggagggaaggagtggggaaggggaggcacgtctcccattctgggtagtgggaggtcaaataaattaaaggaagagtggacagagggagagggtgtccaggcaaccagaggagggcttggagctgggccggaagacagtcgacacctgcaagacctgaaaagggtgcccggtgtgggctaaggacagagagccctgagtggggctccctcgcggcctccaccccttaacagggccctgtggatctgagctgcctactcctcctccaggtggggcctgggagggagcagcttggttcaggacttgggggtgggaagcccaatgaaaacaaggttggggggttcttttccctcacctggggagtaagggatcaccgttttcgaagcctcttcatgaagcagcaagtgatggtaccaaggacagtggcaccagtgactagggccacccctgtacccaccagcagaggcacaaatagggtgtccagggctgggggagagaggatgactgttcagagaggatgccatcatcctccacccatacacttgcctctgcgctttccccatcaagttctctgaacccaccttctccattcacagacacccccatccctgcccacagcctgccccctcagcatgcaagtcagcatcaaccacagaggaccccgtgcaggtgggcactgcagggctggaagttggattttttgagacttcatgtgacataatgtggaggagagagatagtagcaggagggtcagaagatgggaagggaaggccagtggcagaggccaggaggaaggcagagtgaggagggtggagggggtgtcactcaccatgcatgtaggggtagactgtaacaggccctgagcgggcactgcccgcctggtaccagctgtagtcggcatgctgcacccaggcgctgggggcacagtggtacacgccttcatcctcgggccccaagctgtgtagtctcagccgatggcttcggggccccaccagctctacgctgacagggcctcctccaggccggactcccagctctgccacaccatcctggcctacgccacccaccagctgggcagggacagagctgagctctccgtcctctggtcgctccacccaccagctggcggccagccgcagtcctggggggccaccccgcacagagatgttgcacagcagggaggcagtctccccgcggtacactgtgcctcctgctagccatgccacagcctccagcaccacacctgcagaacaaaggacatggggtcagagggtgcagggccagggagcatggggttagggctgccgccaagcaccgccccaggaaactcagggtattcccacaatcttggtagaagaggagcgtgaggctgtggcctgcaaacagctgacggagagggaggggtcatggaaacagaaggaaaaggggttgacaatcctcgaaccccgtccagggcccagccccctctcaccttcctcccgcacatgtacagggagaggccgggaacgggcactggctgcttcacgaagccgggtcccagaccctcgaacataggctttggcgaggcagcggtaggtgcccgcatcaccaggcctggcagcctctagccgtagccggtatgttctggatgccaccttctccatggcaatgtgtcggccctcatagccagggcccaggctgcccacaccctctgtgtccagctgggctaccaggcggccgggccccaggtgcccccgcaggtgccatctcccaacctacagagtatgcagcatgacggcctgctgggggaagtgcccctgacacattgcacagcagttccaagggctcccctgggccgatccgacgttcaccaggccccactgtcactgccagctggctggctgaaacacaggtaggggaagaggtgtcatggaggcaggaggggacacagaggcacccgattccccaacttcctgtttcctacttgacagcagcaacttcaaaacctcctgtctccccctcactaggtatgaccatctttctatttaggggcttgaatctcacccctcagcatgggcctcctatctctatacccaatttctgagcagagaaaacccatcaagggccgggggagagaaatgctagcaaggctgctcactctgtggaagatgagttccttggagtcagatgatggctatctggtaccccctgtggccacagtgcccaccaggatactgtccctcccagctcccacagtgggatgtataagtggcacttacacagcgtctgcacatccacgtgggccaggacggcccttttctctgcaatctgggcccagctgccatcaggatcctgaatccactcagcggcagtgcagtggtaggtgcctgcgtcccctgcctgggcaccccctactaccatgcggtaccgatcggtcccttccttgcccagacgaagctcccctgcagccaatcgctcagcatagggagctccagcctccacggccaagtctgaccggattcccaccacttcctgcagagttgaccgcccaactggtgcctcgggcacagatcgcccaaaggacactgccaggtgtgtgtgcttctgtgtgcttgtcctcgccaggcagcccagtgccagctcctgcccctcatgcaccgtcatgcgtgggggtgaggttggggcctggcggcctcggggccctgggggggcagcagacacctggaggacatctggaagaactggagagaacagctggagtgagggagggctgggagctggcagcccttgttactgtttcctgtgtatagcctatctccctaaataaactgtgagctcccagagggcaaagatcgcatgttgtattatttcttctgtaactcagtggtgccaagggcagtactgggcacagcacaggcgctcaataaatacttgtagaatttcatagaaccagcccatcgcctactcacccttatgtttgagactgacctctgtttgaaatactgagaaaagcggctctttcttctcagaagacaaagaaacttaagagagtgagaatgtcacatggtctaactccttccctaactctactctctttcccagatctgggtcctgtactgtccaggagtagaggctattcaacccaacagtcttcttcgttcttgggaatggaaagtggactggacaacttaaggacatttcttctcccaggaggggtcttaatatgataagatgagcactggcctgggtgaggaactctgggtttgagtcccacatcagccactgagttattgggtgactttgtgcaaatcacttaacctctttgggcctcaagttccttggctacaaaacctaaggggcaactagataggtcacttgtggccttgactttctgccttgagagggtgtgtggctccaccccgtcccagggcccagtacctctcagctccaccttgccgctgtagctgcccaggtagcgggtatcagtggagggggtgtggcactcataaatgccggcatcctgggcctgcaggcgggcaatcttgagcaccacggcatcaccttgtaggcgctgcacctgcacctcacccgccaccactcgggacttgaagacagcataggagaactgggtatccttggtactgacaatgcccagtgcagtatctggggcctcgggcctatacaggaaccactcgaagttctgctgggcagggccctcatagccggtcacattgcaggagatggagacagctgtgccagccacgcggtacaagggcccctcggggaccagcacctcccgggcccagcatcccattcctgtagggaaaggcagaaggagttggagatgcctggttcctcattccatgccctctgccgccacaagcaccattcttgatctctgcctacaaaaggaaaggagacctgggaaagcttgtccacagcttggaccctgttctgagaataggaaagggatgctgtgatataagacacctggatctcaaggaggtggcatgggcccaggattgccttggcatccagatgcatcccatttctggcggactagaagcagagcacctgaaggcagaaaggagtacatctgattcctgacctaaccaggccttggttccaactgaaccttgatctgtccctgccactcacccacctccatgtctgccattccttcctcagcacctggcaaggggagccttctggctaggggactctgagactacatgtccctctcctttgcttgaggggagctggcagtcttgctcagaagtgctagttggctcagctgtgtcacctgggcgagacaatggagccagtgaccctagctggaaagggcacaggcccagtcagttctcaccacacaatgccctcccctctccagctgcgccatgagctcactgcttctctcaccccacagggctgcccaggcagctggggcttctggggcaagatccaggctctgccctggccattgggggcagaagatcccctcctccagtgcctgccaaccttccgggctagcccagcagatacagaaggtgcctgccccagttccttaacaaaagccttcatttgcacatggtatgcattcatttacatatatggctctctttctgtagggaggcactaaatccccagctgccccttctcatctctctcccttcagaaaggccaaacctctcttcttcaccctactccacccctatgcccaaccctaccccagcagatactcctggcagacttagagggcttagctcctcccttctttccttccatagctcccactagataagatcacagaacctcaatgtaaagagggctaggccacccctccccacctctcccaattttacagatgagaaaggtaaggcaggaaaagtataatatgttagccaagatcatgctgtccctagatggcttccacacactcctccagaggggcaaaaccagagaggaagatggggaaactccaaggccaggcctgaagggactgacctcaccaaccagagtgtcacttttaggcctcccagggggataccatggactttctgcaggagctagaggaaaatgcccaggagtctgtggtcaaactctaccctccagcttctctagaacggctcctctgaacttccccacccctgcttctgggctcctagccccttccttcatcctctggctgggtcacagggagaactcatggtctgttgttaagggcacagctgccagtcaggaagtgggattccagcaccatccccatgcccagctgtgtggcctgggatccagtctctttctgtcctaggcctcagtttccacactggaggagaactaagagctccagctctgaccatgtgtgagtgcgtatgtgactcaggagagccctgccccaggccaggcaagtttcataatcagagtgacggtggagacagccaagctgacaccttccctgactgcctcagggcagactgctcagaaggccccctcccattttcctggctccacaactgctgatgcttggagatgcccatgggaaagtcacctccacagccttaggaaatcagttgccacacagctctctctcccctcctctgtatcagtcgcagcaaggaaagggacagcaaagaggcctgctttggaatcagatctgtgttcaaatcctagccccaacactcactaaatgtgctctctggggcaagttacttcattttcctcatttgtgaaatgaatgtaagtgcccacaggcagtgggtgctcagacctctgcgtgctcctttttcaaacacaggccagcacttccccacctccctgggctcctccctgctccatgctgcccactggggaaaacacaccaagtgctaggcaacccaggccccacagcgccttcctctctgtacatcctcctgccacctgcccagggaccagggagaggactcatcctaaccctgcagggcccagggacctgcagcaggggaaggctttgcttggtgccactgtggagctctggtctagaaacaggcagctggggctaccttcagcctctgccttgacgacagcagctctgaagtcaccatccccacccccacgcttcactctcatttcaagggcttcagcctcatcaacatctgtactggcagtttcactgtctccatgccatactcttccccagaccacctcctacagggagccctccagttcaggccaaaaacaattccactgtcattatccccatgcatccatgcaagattggcccagaacaccccaccatgaacacccaccacagcaggcacaaggtgcttggagatcccaggatcagtctccatggaacctggtttctcctgaggcaaggaagctggaactaagcggtgtgaaaactgatgggtggctgcagagccaagtgccatttgggagacaggaagaagggcaaagagggacccaacccagggtggagatgggggtgagagagggaactgcccccagttgatgaagtgcgtggagcgcaactgggagagacttacttcaaagatcgtgggcagaactggcctctgggcctccagccaactctggggcaattatgaagctgggcaggcactgccctcgtagggcgggcacccaaggccaggcctggagctgagtgtggggcagaaaggagtcgcagcatttggtgcagcgaccccagtacgtgggtatgctagctgagatgtgtggcctgccccgggaggccgagcagtgcctggggcagcaccttagtgggtcctctctacgccccagtccctggcttagagctggggagcctgcactcttcccaagactggctcggcggacagccacaaagcgcagctggacgccgaccccggggaggctggaggtacccctgacggaggaggatgtgaggagccccgaaatgctaggggggtgctggatggcaggcacctgcccggcagggccgggaaccggaacgggggcctggcttacctagcattagcagcagcagcagcggcagcgaaggcggcagcagcgtgggcctgagggcgcccatcctgcgcggccagctctggggaggctccgggggatggcgcgggttctggggggccggaagggtggggggcgcatgcccaggttgagggcaggaagcggggcagcgaggcgtgggtgcgccgagcgagctgaactggagctgccgaatcccctccctccgcccctcccgctgctttccctccagccctcggcagttctgaaaccattctcgccccggcccgccccggcaccgccccttccaccgccccgtctaggcccgccaggactacagtcggactccaatcctggctcctccccgggccccggccccgccccagtcccaagccgcaccccttccccgtccccgcagggctaacgtcagcctccaatcctggctccgccctggaccccggcctcgccccgcccctggccctggctccgcccgaggcccccgcaggagtgagctaactgcacctctgcgcatcgaaattcccacccaccctcgcacagagcgcattccaccccgcacctgccagcctttcctggagagttgggtgcagggtccctgggattggcgaggtgactgtgaccacgcatttagaattcagttatttgctctgagccatagtcctcgctgcaaaccctgctgaagtaggggttggcggaagccaggagttcctgaatgcgaagggtttgagctgaagggcgcttccaggatccagaaggtcactggagacctgtttttcaccccctcagagggcaaaaccaaaagaaaaatggattaggagaggggg

SEQ ID NO: 1581 - DNA, 3029 bp, Homo sapiens
acatttaggagaaacagcggtgtctgcggctcccacccttcggggggcccgtggggggggcggtgtcaggggcatggacgccaccccccaggggtctctgctgccggctactctcctctccacgtgctcccctccaggacccccgacgccgcctaggcgcccagcgacgcgcggcaggtggcagcagctcgggcccccgccgcactccaggcgcccgcagcgctcgccctgacgcggccgccatggcgcaggagaacgcggccttctcgcccgggcaggaggagccgccgcggcgccgcggccgccagcgctacgtggagaaggatggccggtgcaacgtgcagcagggcaacgtgcgcgagacataccgctacctgacggacctgttcaccacgctggtggacctgcagtggcgcctcagcctgttgttcttcgtcctggcctacgcgctcacctggctcttcttcggcgccatctggtggctgatcgcctacggccgcggcgacctggagcacctggaggacaccgcgtggacgccgtgcgtcaacaacctcaacggcttcgtggccgccttcctcttctccatcgagaccgagaccaccatcggctacgggcaccgcgtcatcaccgaccagtgccccgagggcatcgtgctgctgctgctgcaggccatcctgggctccatggtgaacgccttcatggtgggctgcatgttcgtcaagatctcgcagcccaacaagcgcgcagccacgctcgtcttctcctcgcacgccgtggtgtcgctgcgcgacgggcgcctctgcctcatgttccgcgtgggcgacttgcgctcctcacacatagtggaggcctccatccgcgccaagctcatccgctcgcgccagacgctggagggcgagttcatcccgctgcaccagaccgacctcagcgtgggcttcgacacgggagacgaccgcctcttcctcgtctcgccgctggttatcagccacgagatcgacgccgccagccccttctgggaggcgtcgcgccgtgccctcgagagggacgacttcgagatcgtcgttatcctcgagggcatggtggaagccacgggaatgacatgccaagctcggagctcctacctggtagacgaggtgctgtggggccaccgcttcacgtcagtgctgactctggaggacggcttctacgaagtggactatgccagctttcacgagacttttgaggtgcccacaccttcgtgcagtgctcgagagctggcagaggctgccgcccgccttgatgcccatctctactggtccatccccagccggctggatgagaaggtggaggaggagggggcgggggagggggcgggtggggaagctggggctgacaaggagcagaatggctgcctgccacccccagagagtgagtccaaggtgtgaccagcttcctccagacccctgtggcagaccgggggccagacacagatacatggggaactgcatatcggaggtggtggaggaggaggaggaggaggaaggcaaagcccctggaaatgtgctaaagttggaaagtccccgtcccccagaacctcaagtctagaaaccagtatggaagggaggggtcctgatttcagggaaatggagggtggggccgggtgaaaatgccagtctgtgtttgaccttcacatttgttcatgagtggatggatggacagaatgatggacttttgggggttggatgggaagatggtagcagataaagacagctgacagatacatagatggaccagtagacaactggtccactcagggctgccactaacctgtagaacacccctgtgcaaattttaaaaaggaacccttttcctccagacagatacagccccaaaccagggtgcatggcttggggagcagagtataggatggattgcagtccccagtcacctcttctgccagcctccccacatatggcacaactgtctaatgacacggtaggccaagctgaagtgaaggagaaaggagccggaccaagatgggcacatgaggagggtgccctcctagctccaccctcaccaggatgaaggcgtgcaaggggctcagcaaggtgtgaatgaccttagtccgcaagttcagggaagcaggcagagcggggaggtgcctgagctggggcctggagaggggcctgggaaaggaaaaccagggatagctattttcttacagtggagtgagatcttacaggtatcaggcacaggcaggaagagagagagagaggttctggggaggaagggccaggagagagatctagaaagtgggttcactagagctgggaaacagggagcccctaggaaagcagtgtgtccttggggcacagtcattcacatcactgattgggtgccatgtggagtggacattcaaaaacctggttcctgtcctcaaaataaggggcacctgggaaaacagaggaatctacctgtggtgactgaacgagggataattcaaactgacaacctgtgcagtcccgtggagggtaggggagtgtgggtgatcagaaggctggggccagtgtaaggcatagggaatatgtaagtcaggagttagaaatctccagtgtgcgttggaatcacctggagggcttggtaaaacacagatttttgggctccactccaagggtttctgacccaagaggtggggaccaaaaccatgcattcctaagaagtccccaggtcatgctgctgttgctggactgaggaccacactttgagaacctgtgctctaagtgaatacttggaagtcgtttcaggacatggggcatagaaactgaggagtagctgagaggaagatgaagagaagctgagaagaagctgaggatcctcacaggagcagacagagaaatgtgaagggtggggttttatgtgtgggaaagggacccgaagcccaggctgaagagtttaactttgggcccagaaactcaaccatcaatggaaacagggcagtgacaagtggagggggtgtctggaagctgagcaggcccgacagagagatgaag

SEQ ID NO: 1582 - DNA, 1182 bp, Homo sapiens
atggcgcaggagaacgcggccttctcgcccgggcaggaggagccgccgcggcgccgcggccgccagcgctacgtggagaaggatggccggtgcaacgtgcagcagggcaacgtgcgcgagacataccgctacctgacggacctgttcaccacgctggtggacctgcagtggcgcctcagcctgttgttcttcgtcctggcctacgcgctcacctggctcttcttcggcgccatctggtggctgatcgcctacggccgcggcgacctggagcacctggaggacaccgcgtggacgccgtgcgtcaacaacctcaacggcttcgtggccgccttcctcttctccatcgagaccgagaccaccatcggctacgggcaccgcgtcatcaccgaccagtgccccgagggcatcgtgctgctgctgctgcaggccatcctgggctccatggtgaacgccttcatggtgggctgcatgttcgtcaagatctcgcagcccaacaagcgcgcagccacgctcgtcttctcctcgcacgccgtggtgtcgctgcgcgacgggcgcctctgcctcatgttccgcgtgggcgacttgcgctcctcacacatagtggaggcctccatccgcgccaagctcatccgctcgcgccagacgctggagggcgagttcatcccgctgcaccagaccgacctcagcgtgggcttcgacacgggagacgaccgcctcttcctcgtctcgccgctggttatcagccacgagatcgacgccgccagccccttctgggaggcgtcgcgccgtgccctcgagagggacgacttcgagatcgtcgttatcctcgagggcatggtggaagccacgggaatgacatgccaagctcggagctcctacctggtagacgaggtgctgtggggccaccgcttcacgtcagtgctgactctggaggacggcttctacgaagtggactatgccagctttcacgagacttttgaggtgcccacaccttcgtgcagtgctcgagagctggcagaggctgccgcccgccttgatgcccatctctactggtccatccccagccggctggatgagaaggtggaggaggagggggcgggggagggggcgggtggggaagctggggctgacaaggagcagaatggctgcctgccacccccagagagtgagtccaaggtgtga

SEQ ID NO: 1583 - DNA, 68233 bp, Mus musculus
ttaggtagatagttggctttatacttgctacatatgccagcttggcttcaaacttgagctgatcctcctgcccctgtctcctgcctctgcttcccaagtgctgagattacaagctgtctgtacggttgtacgtggcctttttatcttgtttatgtgaattattttatcttacttaactagaatgtaaagaggctcctgtgttaatcttatatatgccgcatgctaccacacagtgagatagatagtagtagataaatatttacttaactataatgtaattatttctttggttagtatttttcccttggcattttagaatttttactttaaaaacctttctagctcattgtctaccaaagattccagagcttcactttagacaaacatcactgttactcagaagtctagtctgggtatagaaacggattcattagtatgtagtgttcatgttagtaaatctcccagccttttatcaagatggtactgatgactgcacttgaactgttaatctcctgcctgccgtaggagatagagactgcgatgtctaagcttcataaagaaacggagtgtgtgaccttgcacaccagtcgtccttagctcttcttagtaaggaagcaggtgatggtagttgtggctagtgcatttcctcggtgcgtgttgcatttttgttggtttgttttgagacagagtcccacgtagcccagggtaacctctagctatgtagctgaggtggttgagccaatccttccagtcttaaccatgcctggttaagtttgttgcttttaaatacaatcaaggaggtcggcagtctgagtctggaagtgagtgacagaagaataaaatgccccgtcgtcgcttcagggaagagggcagtgggcttggggcctgttgcacataactgacgttgacaccataaaggtgtcatgtggtttagtatttttatcttggctcttggttctctttcagactagagcttcaagtttcttacaatattttggtgcaactcaggggtgaagtgtgttaaaaataacttgataatagttgatatcctggacttttgtttcagtctctgaagaattggatgcaagtcaggtttatgatgtctaaccctttcctcttaatgccttgtgcatgcttcttttaagaatagaattcttggaggtttatctagaactgtgtcaaatcccgtttcttttgataactgcatcttgcatctgttctgtctacatagttactgcttacctcaaacttgctgattgatctctctgattatcttcattccagcccacagcagaatgctctgatttgtgtattaggaagaagggatctgggagatggctcagtgggcaaagtgcttgctatgcaagcatgaaggccagagtttgaacctagcactcctgtggtagccagtgcctgtacttccagtgctgaggaggtggaggctggtgggtcccgggcacacatgcacacacccaaggaagccagaagagggcgctgggtcctttggagcacttgtgaacctccctatttgagtactgggaaccaaactctggtcttctgaaaagtgttcataactactgaatcatctctctatccctatctgttcatttttttaaagacacatcgcgcgcgtgtgtgtgtatgtgtgtgtgtgtgtgtgtaaaaattaggccagacacaacagtgggtagcagatagcttaaacatcaataaattcatctttaaaatgtggttgtggaggccatacaataaagttaatgcagatttcaaattttactttggttaaaatgagattatggaattgataggctactgagaaatttaactgaaaatctgaaagaaaaggacaaatagccccttggtcagtgagattaatagtttgttttagaaagataagatgtacttttaaatattgtctaggttgaaatgccttcttttaaaaggtatgcttagggagagcacttgtaatgtgtatgatggggttccagatagctttaatatgtgagtttatttttagtcatctatatttaaagaactgtaaaattagccatatgcatgaaaagtaggcaaaagataccaaagtcctcactgatgattcatggatgagcagagtagactggccggtaaatacagcttacagcttgcagggacattatttctttatcagcaaagcaatcagcagggagccttttaatatttcacagcagcagactacctaggtgatcctggctctgtaaattatattgttatcagtatttatttgtataagaaaatttgagtagcttgctactaaattaaaatatttacagtataactgactgtaaaaactgtatttcagcaacacaggtaattatgcttattttattatgttaccagtggtcattttaattggtaggcttctaagagatttgtgtatttttttatactccttaattttaaaaaatagttttctattctctatactgtgagtgtgtgtgtggtggtgggatcaaatgcagagccttgaatatgctaagcaagagttctaccactgagctgtatccctagcccaatatataatatctgtgattctaagaattctttaggggctaaagagatggctcaatagttaaaatctcttactgttcatgcatgtatacacacacagtggtgttcatgcatgtatacacacacagtggtggtggtggtggtgttattttgaggcagcatctctttatataaccttggctatcttgcctctgcctctagtgcagggattaaaggtgtgtgctaccacatagagctttagttttacttttgaaacagaatctttcaatagccttgagctcaccaagcaggctatgcaaacaggatagtatgctctggaaccctatctctgtctctaaggcactaggattatgtgtgcctgccaaccttttttatatgggttctaagaattgaacttgagaccttgtgcttgaaaggcactgaaccatctcactagccctgtggtttgcttcagtaagttaaagacctcaagctcactaccaccttgaactgctttataattttctagtcttacagaaattgtgaattttcctatcttctgacatctgtcaatattcttattcataggtaaattccaactgaattgaatattaatagtattactgttcattgacaagcttacaatagagtgaaacacaagtctaaagtaatgtaatattgacttaataatgactatattatataattttaaaaggtatttagcaaaattcatatccctttcatcaattgcttccttaaaatataaagcccaccactgaagaacaccaggaacatggtatagtgaaaaataaactttatttatttagcttattgtagaaagtattttcaccccctaaaagctgtgagcatgttgagaggagtcagaaagtctgcagaaggtataaaggagctgaagtcaggttagtagtctgctcaagggtggctcaattctcatttgaatggttttgctgttattctgcacaggctcccttgaagttgtagatcagtttttggactgggatactgagtgtctgtggccctcaaaaaacagtgcttgagcttgggtgacctggactgtacagtggtgtttgctttggttcagtttctctgcttgcaagtcagtggtttgtggcttctgttttctttctctgtctccacctctgatcattctttagttaaaccagggtatttaccacttaagggaggtaaaccaacgagattttaataggttgtaaatgcttatcaagccatttgtgatagatatgttgacctcaagcactggcctatttcctggatggtgatttgttctgccatctggttgacagaagcaacacagtggcattgagggatctggagatgacacactgggttatcccagacagaatttgtatttagtttgaaataatgttccatatatgtcataatcagtttggatcttcctttttatttgttcatctgcttgttttgtttagggaaaaatattacgcgtgtgtgctcatgatgtgtggggatgtttgcatggtgtgtgtgtgtatatgcatgggcacactcgggtgcatgacgtgtggggcatgcatgtgtatgtacatgtgtgcatgctttatgtatgcatgcatgggtgtgggacattcatgtggaagtcagaggacaactgtgtgaaggcggggctcttccaccttcaagtatattcctgagatagagctctggtcaccaagcaggaacatgaagctcctttacctgctgagacatcttaccagtccacaattgtttgcaatttgattttcattgtttacctttacaagtgtctgaatgataattctagtatttagtgatggtcaagggtaaaggtctttgtagtactaacaataaaggagggggtgggagcctcttgacattctagaatcttgacccatagggaagagaacaagatagacaagagatttactttttttgcttgctcagttatttttctctcaaactcttaaaaaagaaaaaaaaggttagacttatttcacatgtttcaacagtcagagagattcagaggaaagtgggtattgtctgagaaggaagcagttataggcaggcactcatcatgtactgctgctaggataataacagttgtcagattttaggtagacatttgccatctgggccagcaccaggagagtgtgtaaacacagttgttagacattgcaacactctagtgttaagttgactccaatgcttacagttgccgttgacttaatgtgctagagggtcttgtcttagacatgaagctgaaggctttgctttgggttttaatcatctgtgatgtgtgttgtgggttgctgtgctcactttgttttatgaatcatcgtgcagacaagttgtggtttctcttttaattttttgaaaaaaaaattgatgatttacattgtatgtgctttggtgttttgcctgcatatgtatggggtgtcaggtccctggagctgaggttacagatagtttcgaggtgctatgtgagttctgggaattgaacccatttcctctgaagagcagccagtggtcttaacctttgagccacctctccagcccttaaagatgtattttattttatgagtataagtattttgcctgaatggatgcacaatactcagtgcaccacatgcatgcctagtgcagtgggtcccctggagctagagctacagacagttgtgaggagccatgtgggtgctgggaattgaacccaggtcccctagggaagcagccaacactcttacccattgagttatctctccagcctctctcttttaattttaaaagacagccagtgtgagtttcttgtgtatttgtggggtaaggggttcatctcatggtagagctatacttcatgctcagtgtgacagaagagtgtctctgtaggctagcatgcctgtaaccttggattgtggaggcagagaaggaaaccaatgcaatgttaaaactagcttggtctgtgttctgagtttaggccatccagggctataatatcaggagactctactcaaaaaacagtcagaaaaacaaaccaccaccaaccgatcaaacaaaaccaaaccaaagaataagtatttgtaattattgaaaagctggaaaaagaacattttgacttgaaggattagtcaagggcctgtattagttttctctcctttttcagataggggtagacattactgggtattaaatttagggcttcacttatacccagcaagcactctacctctgacggccttttcacttccagtaaatggccatagtgccagcgaggctccagctctcacaggtgtacaccactcttggctacgggggaagcccctttacttccccttgaacctgggaagcttgagatgctcgaatggtctgagttggaagtggtgtggtgtggctaagatgcttgtccttggaactcagtcacatgaaaggccacctacaggtattctcatcagatgagactgccctgggctgtatgagctgggggggggggggggaggcgggaggatggtgggggagcagtcctgctgtgtcttctctgagctcatagtactgagtctatacatgagagaacctatacataattattgttttaagtcactatgttcagggtgacaaatcaaagattgtgggaaagaaatatacaaggagtttagcagagggtggtcatgctagcctcagctcttgggaagctaaaacaggattgtctagcgttatagagatgctgtctcaaaagcaacagcaacccaaggatgttggtagcaatattaacttataacaataagtaaaaattttaaatagtctacttaatagtaagaaaataaggggctggagagatggctcaacggttaagagcactgactgttcttccagaggtccctgagttcaattcccaggagccacatggtgactcgcaactatctgtcatgggatccgatgcacttttttggtgtgtgtctgaagatagctacagtgtactcatataaataataaataaataaatccttaaaaaataaagaaaataaataaactgatacatttttttccataaagaaaagatctgtcttcaaaagaaaacaatcagttctgttataaccaatgtcaaaatggtcccagtgtacacacatgtaaataaagatgattaagaacaacaacaacaacaaattgtaggcctggggaatatagctcatcaacagaggcttcctagagggaacaaggccttggatagagccccagcattaccaaaatccaaaacagtcagcaagtttaaaaaaaaaaaaaggaaggttccaggtgagctgatccataactgtaactgtgtaaatatcagtaccacagcgcttcagctggtctgtgagggaggacaccctcattatgtaacgtttaaaatcatggctttagatggcttaaaaccttcctctttagaccagtttgattttgaacaactagaagaagtgtacagattgagcacacagtattaaagctgccagcccctccctactgccttcagggcagtctctgggcttcttattttctctgtctctgtctcaggattttcttttttaaactttaaatgttgaaacttaatccccagccctcatgcatgctctgccagccctcttggatcatgctatacacttcatgaatcttaactgcttttatgatcttatagggacttaaaagattggttttcctaagaagcaccaacttgtcactgtaggcgcacagtaactaaaagctgaataaaacattggcatctgtgactttattttgtctgtctcttctgttatgttaaacttcaggtctgattcctgctcagctgtgcacatagacatattaattacttaaggagtgtccatctaaaaactgcttatataaaatttgttagccttaaatttgcctaacctctctgtaaaatacaagaacgaagacacgggaatctaaggtactttttttaagttccagaattttgtaggcagatcacacagtgatgttactactctgccaaggaggagcaattatcccatgaaggaaactaaggcagattccttatgcaaaagtaatctcttgatgagaattctatcaccctcctcaagcagtaaagactcttatgtagccagcaggaccttgcaggatcaaccaaaataatggtcaactcgaccattctagtcaaggttagctgtttatcagtcaggcaaacacaccagctgtgcaacaccatcccttctcctcatttctctaagactcagagttccttccagaaactcaaaagcagatcttaggttaccagacatttctgtacttcctagttcagccttgatctgtctcttcaattgactttggagacaggtggtcaaacctagtctattgtgaaccttcaggtcagggattgtgtcctaaactcctacaaaaaccttgcacttcagctttctatttaaatatagatcttttactacatcatcatcatcattttcttatgttaaaacacatctctcacttcaaaggaaataagagccaaatatgagtgaccatggtctttgctgtgacctgacatttgacaaatagcaactgaagaaggaatggtttgttttggctcctaggttgaggctgtagtatatcatggtaggaaagcaagagtggctccagctgctgtggccctgggtgccagcccacacgatcccctcactcttgaactttgcttagctgtaaaaccatcaccacgtggacagttgttctggcaactcaagataaagcttgggtctctcctgcagatatcgtagcctctgtgcccgttgtatctgaactgggaaacactttctctaggtggttgatttttgagtgtggaaccccttcagctgcattctttcttcaaccccttctttcaaaagattttctactttaataaactggggctattgagtccatttcctgttggcccagtacaaatggaaggttgttctttagtgatgctaatctcatacagtagagaaatagtcagggtaatagccccacttctcagtaccaattttcatatagtcagggttttatagaagaagcaaaccaataaatgtgcatatttctgttataaaaggagatgtattaggttgacacatgtaacagggcccagtggtggccatctgtatggtggagagccgagaacccactagttgctctgtccatgaagctagatgctttacacagtaccaatctggcactgaggcctggagcacccgagaagaggcagtgctaggaagctgaagtagcaaaagatgcccctgctgagaagtcacgagggaggccgcaggtgcacactacctttcccttggacccctttattctggatttcctgttggagcgtgcccactgactttgagaataggttttatcccctcagtaaagcccctctggaagcaccttcacagacatactgaaaggtctgtctttcttgggtgtttttaaagtcttcagattgccgagatgaataactctacactccaataacattacagcatgaaagaggttatgtggactttttatagttccaggaggatcaagatatggagccagccagtggtggcgcacgcctttaatcctagcacttgggaggcagaggcaggtggatttctgagttcgaggccagcctggtctacagagtgagttccaggacagccagggctatccagaaaaaccctgtctcgaaaaaaaaaataatgagttagcaggttacaacaaagttaataagtcttagatgctatatgaatgagattcttagctttggggttggtggaatctagcagcctgctaaattaattcatttcaaaggttttgcctcatagttgaaagttatgagaggtcaagcattgaagtggatattaatggcttcagggtcctatgttgtccagtttgaccttccactatctttgtgtctgaggatgaccttgagtgtctgttccagctgcctctacattccaggtgatgatgggattagaagtgggagccacccagcctgctttatgtgatactggggatcgaacccagggcttcttctattcaagggaagtactctaccaactgagctccttcttcagccagctgtttcacttagacagatgtatttgttgcgttcatttcttcatctattcattcagtggatgtgtgtggatgtagtcatgaatgtacagacaaccacataacttgaactgtgaccattttaaaattagaatgatcaattctgctacacagcttcttagactttttcacattctaagactgtgcagttatgattgcttattaggcttagtttattttaagaagtatgactgtgcttgttatcggtacatttaaatatttgaaattgttttctcttccttagctgtcccctttcctccaacccgacggctaactttgaaggaagtttttgagaatgggaaacctaaaatggatcttttgaaaaaccatttagtaaaagaaggtcgggtggaagaggaggtggccttaaagatcatcaatgatggggctgccatcctgaagcaggagaagaccatgatagaggtggaggctccgatcacaggtatgaaacacatgtgaatgaaacgcacacgtgtgggtgccagcccttaggtttgtgatagtttgagaaatgattaccaaaggccagctgaaatgagtgtgataaatatttctctaattttgaagcaatctagggattttgacttttgttgcttaaaaaacaacattagggtctgaaacttggtggataagagcacatcctgtcttgcagaagactggagtttggttccaagtgtccatattagatggttcagagccactgtaactcccagctgtagggagaataccacacctctggcctctatggacacttgtactcatgtacacacacccctctcccagacagatgcacacatacacacaaaattaaaaataaatctttttaaaaagaagcatactcttaactgcttcatattgataataggggcattgagttctgattgagtagctaaatatacagaagagcagtgaaaaggaaagtgattaaactgaagtcctgttgccctgatgcttcttcctaacgcacagtttccacctcatgtctttctcgcctagtgtgtggtgatgttcatggacaattctttgacctgatgaagttgtttgaagttgggggatcacctagtaatactcgctacctcttcctgggtgactatgtggacagaggctatttcagtatagaggtaaaattaacatggctgtactgcccctattgtatcatattctaaaagatctgctctccattccttagtagaaaagattaagatatgaatgctgatagaatttatccactttattacattcaactaatagagatatgctttttttctcaaaaaaatctatccttttaacctgtagaaaacctgtcatatgggaggctatattaagctaattttgaaaatagatatttgctaaggttttctccttaaagatagctgtctgggatatagggacatgcatagcttttcattctaaacagtgtctgagctaagtaccttaattataatactgcagccaacgcttaggttaacttcctgtgggaactaggcactgctggctgagctactgcaggagggactctggtcctgttgcacacggctggcattaatgtccactagaaggcaaaagatgaagtgaagccaataaaaactgacagtttacctttatgttttaagaattaaatgatggaacatgagtaggattaaaaacaggtatgtgcttttgtgggtgaacataaaatgattttagggcccaatacaaaggcttgaggaccatgtaattatagcacatctgcttcacaaataaaagatcctgtgtgaagaagtcttcataattaagtttgtaatatgccctagaaagaacaggaggtgacaaattctgtcgtgttttagtgctttaggctatgtgctcttcatagtgtggggatttcactgtattggctgctcctgctagagaaaggtctcctcctcttcctcctcttcttcctcctcttcctcctcctcctcttcttcctcctcttcctcctcctcttcttcttcctcctcttcctcctcctcttcttcttcttcctcctcttcctcctcctcttcttcttcctcctcgtagtcctcctcctcttccccttcctccttgtagtcttcctcctcttcttccttctcctcttcctcttcttcctccttctcttcctcttcttcctcctcttcctcctcctcttcttcctcctcttcttcttcctcctcctcctcttccccttcctccttgttgtcttcctcctcttcttcttccttctcctcttcctcttcttcctccttctcttcctcttcttcctcctcttcctcctcctcttcctcctcctcttcttcttcctcctcctcttcctcctcttccccttcctccttgttgtcttcctcctcttcttcttccttctcctcttcctcttcttcctccttctcttcctcttcttcctcttcttcctcctcctcctcttccttgtcctccttttccttctattgtttttaaatgtaactcaactgtctgactcagttttcaaagaagagtcagttctgaagaccccagaagaatgaacaacaacgtatgtttattttactcttcagttaagtagcagtatagggagctagggtgtaagtcactgccagagttcttgtctagcatgccaagccctgatgttaattcctggctctgaaaaaacattgtgtgtgtgtgtgtgtgtgtgtgtgtgtgtgtgtgtgtgtagggtaggcattctaaatcagaaaagttgagttttatctgttactaccccagactcattagtgtcagattgagaaggacacaggatactgctatagactatgacattttcctgctgagccttgtcctgctgctcatgctcacagtgagcacccggggatagcctctgggcagagactgggatgggtggaaggcatgtcttgagatgtgtcactgaagaccttgcctattgcagtcaggaattgactgcagggctgtgcacttcagtagatagtgctaatgggtgggtgtttaaaaggtagaagataaagaataaagagtgttttcaattatctattcattgttttacttaattaaatatatttttgttgttttgggcctcctcctcctccttcctccttcctcttcttcttcctccttctccttccttctcctccttccttctcctcctccttcttcctcctcttcctccttctttgtattattattattatttcttttgtttttaaagttgtatttatttatatgaatacactgtagctgtcttcagacacaccagaagaaggtatctcattacagatgattgtgagccaccatatggtggctgggaattgaactcagaacctctggaagagcagtcagtactctaactgctgagccatctctccagccctattattatccctttacatcctgaccacagtttcccctccttcctctccttccaatcccttcgtttttgtttttgtctaagtatttcatttggtttaggttagcctcagagttgctgtatatctgaggatgaccttagtaaacttccgatccttttgtgtccatgcttccatgatccttacatagtgctgaaaattgaacccaggattttgtgcatgctagggagatactccaccaaccgagctaattcctagccccagggacaatgtattaaacataaacattagtgctggagagatagctcagcagttaagaacacagcctgcttttgcataggacctgggttcaacccctagcacccatatcttcaaatggctcacaaccatctttaactcttgctccagatgattctggcctctgtgggcaaatggtctcatgtgcacacaagaacaaatgtacagaatcttaaaaaatacaatcttgaaacaaataggacaaaatattttctaattattatgacttacagttaattaaaaataagactttataaagttttaattttaattttgtttactttaagtgctagggattgtcccagtgcgaaatctaccactgagcactatccccaggctactgtttaattttggaagcaggtgtctttgtgttccccaagttggttagttgatctttctttccttacccttaccctcaccccaccccctctccatggtttttctctgtagcccagactggcctggaacttggttggtcatgaatttctgctccagtctcccaaatagctgaaactacagtcatatgccctcctctggctctagttcctggttttcaaatagtttcaattcattgatacagttactgactcatgttctaaaatccacagtgagttttgtacctctgtgctatttccaggaaatttcatgttacatggttttccctcctttattagtaatttcctgagtaacaactttatagcaggctgtagaatccaatctagaatgagattcagatagaggtaactcagcagtagaacccttgcctacaggtccatccccacttacacacaaaaagagtaaaattcgtgttctctggaggagctagcagtcctatagtacaggctctcctttcagcgggtcttctagtataatagaagtcttcctataatcagcagtaggaatcttcgtattaagacctttcccagggggctagtggatggctcagtgtagaaaagcatgtattgttcttgcccaggacccaagtctggttctcagcacacatattgaaaggaaataaaacttgagacatgtgattcatgtaatttatgtcaaatagcccaaagagttgtttgtgagctttgaaacctggggctgagaacatagcagaacaggccaggacatgcccgggcaggcccgtcgttacatgtcctgactggcctagtgcctacctatctcccacccttctgatagtctgttaatgtttaaatggaccaatcatgtaaaaccgcgccaattcctcccccagccccaccccttttctataaaagtccctagctcccaagcctcggggtcgaaaccactgtctcctgtgtgagatacgtttcgaaccggagctccgccattatggctccaccatgtggtcgacacctctgtctcctgcgggagatatgtgtcggcccggagctccatcattaaactacctcatgcttttacatcaagatggtcgtctgttcgtgattcctgggtgcgcgctgaacgacaattgagtgggggtttccccactaggttctttcaatatcaggcagctcacaactgcctataactctagctccaagggatccaaataagtctcctttgggcacttgccctcatgtgcacatacttaaaaacacaggcatatacatacacacataattaaaaataaatcttaaagacctcgccaagtcttctaatatatagtaggcattcagttttaatgaatactaatgtaatttaattgtagtttgcatttgactttgttattttttttacttgactgatttctctaaaatataacaaatgaattgaaggttttagataacagtggtggtctaattgttttctttttaagattttcacttatttttatgtggataaatgttttcctgaatgtattcaagtgcatgcctgctgtccaagaaggacagaagacagcaccagatccctggaactggagttacaggagcatgggaccctccatgtgtgggaaccaagttcaggctctctgcaagagcaataaatgcttctcactgctgagcggtctccagctaccactcctcccaggttttgagatagcatcttatttagccagacctgaagcttgctaactaaggctgaccttggactccttacgtgcctgtctccactcccaggtgctggctgacagcgtaagcataaaccaccacgtctaggttatgtttagcttttggatgcaatcatttttattattttcaagttttatttgtgtgggggggggagaaggaggggaagggaaggaactcgggagggagggagggaggggagggtccatttatgctttttgtatgcaaatgcttgtgggcagaagaggatcattcaatccattctcttggagctagattacaacagttttgagctgcagatgactgagttgggaagtaaactcaggtcctctgaagaacagcaagcactctgagcacctctccagcccctgtctttttctatttttcctctggtcccccacacaccatcgctacatactgtactcctgaactattcccttactctgactttttgttgttcttttaatttttttcttatatgtattttttaatactgtaagtcctttctagatttaatcatttattttatgggtatgggtgttttacctgcatgtatgtctgtgtaccatgtgtctgcacacagaggccagaagagggcgtcagatcccctgggacgggaactacctgtgattgtcagccaccacatggaacctgaatctgctcacctataagagaaggactgctaagctgtcctcatagcaccttgaatgcatttttaaaaagaaaattaggacaataatggatattccttctgtgattcttttccattcaacatcatattagaaacatttttatcattaatttttctatgatgacacattactggcaaaaagtccatggcttgctttaccattcctttagtgttgggtaaataggcttatagaaggttgctcactgcctttccccctcctccctcaggaacaaaacccctgttttgttccaaaaagtagggctctggtggcaaggggaactttcagactcaagaaaggaagccttttatcccaggccagggaataatttctgattgttctgaccttgttaaagtaaatcctgccacttgtgattagcctcaggatatcacaggctcattctgcctggtgatgcataagacagctctctggtgctattcttggtttttgtttgcttggctgccctatgggcagcttcctatgtgaaaagactcttgggaagaaaggtaaagctttgggctttgccttattttgttgatgcagaatctcacaaagtccaaactggccttgagttcattttatagccaagggtgagtctgaacacctacctttgtcttccccaggcagcgggtgcagcctaaagcttttggacatctattccaccctgtcagttaaatgtggatgggtgtcccaaggcagccattttatggctgtgaggactgtcctgtgagtcacagaggaatgagtagcaggagcgggcctggtttctgtgacagtgttgagaccatcactgaacatctgtgtctccacctcttatttaattagaatgctaattggctttgtggctgtgtcttagattttaacttttaaattatattttctgtgtgtgtgtttatatgcatgtctatagaagtcaaaggacaacttataggagccagttctctccactatgtgggtcctaagagttgaactcaggttgttgggctagcagtaaattccataacccactgagttatctctcaggcccagctaattagattttgtatcactatactgaaaatggcacaaacttattttccattttttgctctgtacattgcagaagttagtgtcttgtagaatattccttgaatttacaaagatatattactgtatggggtggagtgggtgggtgtgtatgctacagtgctcaaaggacacctttgtggagtttgttgtgactttccacctttatgtgagtactctgattgaactaaggctcacaaagcaagccctttacctactggtcatcttatccggatacatcgttgatggcatgacagactttagatcatagtcttaaatgtaagttcttgattttctactgagaattttgtatgctagtttctatataatttgtttaccatctatgaatttgaaatcagtagggataaagggagataggaacaactaatttagatggatcactcagggcaggcctttcagagatgaggatatttgggtagaaacgggaatgaccttcaagagaaagcacagctgagtgggagtcccttgtgcgcagagggcacagagaatgaaagctcagtgacagggacagcccagacagtagcaaggctgggcgggcggggtggggaggaagagctgctgcaggcagacagacagactgacagataggcagaccttgcaaaccatagtcagggagtttagatttgttctgggtgtgatatgaagcacctgcgttgttattttaattgctattttttctgatgtgggaggctttgggaggagcagcgctgccatatttgtgtcttacaacaattactctgactgttatgtaacctgggactgctggagcctaaagacaggcacagaaaccccacttaggaagattatctaataatgcttgagaccaggtgtgcttctccagaggttttcaagtattgaaggatttgcatagattttgccagtggagcatgcctgtccaaaagtaaaatcttcgaaatgctccagaggcaaatcttttggagtatcacagtggcattcactgaggttcagattctgcagtatctcagattttggaatttggtaatcagtctgtgatatggataagagataccagtaacaaattaggatggacagatggagagacagacagatacacatacacagacacatacagatacgcagtatctctcctcctcctcctcctcagataaatgaaggagagtacccaccttatctgcactcaagggttttcacccttccggtctcctctttagtgtcaggcttattaaactttcccatgtttcttaactagataagcatgcatttcgtatactcctgactttataaagggcaacatcccatactcttttctatactcaaaatgactctgaaacagtttacatagttctttctcattcccttgctatagtgtcatggcgttgcttagcatgtgtgtgtgtgtgtgtgtgtgtgtgtgtatgtgtgtgtacacatgtgttcattgtcagtattttactatgataatgttgagaacttttgcattgtctttaccatgcaatttacgtcttgtcttgtcttttgacaaggtttctctgtgtagccctggctgtcctggaacttactctgtagagcagtctggtcttgaactcagagatcctaagtgctgagatcaaaggcatgcataccacccagcttttttttttttttagatttgttttatgtatgcgagtattgaccaacatgtatgtatgtagcccatgtatgtgcctggtagcccagaggtcagaagagggcatcaggtaccccagaattggggctaatagatgtttgtaaatcaccatgtgggtgggtgctgggaactaagcccaggtcctctggaagagcaatgagtgctctctcttactgctgagccatctctccagccccagtgctccttcattcttacatgatagaaacatgtctgtctggatctctagtcaatgaaatttcttccctacagcccatgcattcttgttaaacttcattttaacctgtggacccctcattcgtttgtcacttgttgggtactatgtaagattagatctaagtttactatttttttgaaatggcatctaaccccagagctgtttcattaaaaagctcattaccccagggatctcctccaccctgtttttatgagatgaatttttatactgtagtgcaggcaagtctccaattcaaggcagttctgctctagcctactcggtgctggggttccaggatgagctgccatgcacagctgttacctggtgattagagatgccgcctttattgtgtacagatgttcatatgaacttggatctgtttctggactactggaagattgaggcatgtggcagggcacaaggattttattttattttattttatttgaactgaagttttattatataaccaggttagtatagaaagtagtctaagctagccttgaattcattgctctttttgcctgagtacaggggtgacaggcctatgctacttcatctgactcaggacattatgtttttgtttctgtatttggttttggtgttgttgttggtggtggtgttttgtttttttgttttttgttttggatacaatatgtcatgtgaccttgaactactggttcctcactgattcttctgcttccatctcttaagggctagtattatgggtatgggacattatgtatgtttatgggtcctaggatcaaactcaggaccttgtgcacggtaatcaggcactctaccaactgagctgcaacccccagctttttgttgctgctgttgtaaatattattcgtgggggtgggggtggttattctatttagaccatatagttctcaaagacacaaaaacctttagttttaaaataagccttaaagcactagagctgggcagatatcagccctctatgctcttttgtctactcccctgtcaataaccctgagatatcacttgtgtgttgtgcctgggctgctcctgttctaacaggctggccctcatggctgtgctctcaccattcatctcccccacagcgacttctgccttctccccctcctccttgttgtggtccctgcctgagccttctatctgccctgcccctctcttttgtacagcccaggctgtaggcatctttattaaccaatcagagataacttggaagcaagttttatacaactaaagctggcatatgtaaggatctgttcttctcagagcagtgagatcttggggtatagagtttagcatttgaatatcagcctcaccagaacaactgccatacatgtttatttatgtattcaattgtatatcctatcttgctgaattctttcactaagctactttttatcattgatttttcaggggtgttttttagttatacaattatattgtcagcttttaatttttcctttacccattctacctcaatatttagatacttagaggttttttgttttgttttggatacttagcagattttaaagaaggttattaattttaccaaatttaaggataacatgcaaaagctcgaagattacatttacaacttgggacttacagtgagatataccatatagcacatcatttagatttagatcaaatgtgtttatgtattgtcatggtcatgaagaacacttatcctctaattgtgtctcctagtgtgtgctgtatctatggagcttaaagattaaccatcctaaaacattgtttctgcttcgaggaaatcatgaatgcaggcatcttacagagtacttcaccttcaaacaggaatgtgagtatacatctctccagaacagtcagttatctcaggtgctgccacactcagttaagatcataccttcaaaatgaaaaactcaagccaggcttggtggctcttgcctgtagctcagcgctcgggaagctgaggcagaaggatcaccacaactttgaagccagcttgggctatagagtcagacactgtttaaaagaagatggagaagaaaagttcaatgcttttacattgcttatcagagaatgagtttgtttagcacacacactccactatactcacatggtagtctccatttgacaaggttataattgagtcgcttcactagacaggttataatagctgccttcttcccagtatagcttgaaaggaaaggtcagaattattaaagaaaattgtaatccaggcttgatagacatatctgtaatcccagcacttgagaggtggagacaaaaggattaggaattcaaagccagccttggctatgtggtgaattcaaggtcagtttgagctatatgaaaccctgtctcaaaaaaacaacaaaagagacaggatcttcagatcattccagccccagaaacttcctgaaataaacacaccatcagataataaccaggaagggtttcaaagtagatttactcttggtagggatttaaattggtgtcaagtatttggacagcaattttgaaatatttgtgaagattggttttgtatttgtgaagtatacattctcttctctcagtattttgactgctaaagcaactgtcaggagtttagtgactcccacagggctcatgtcacagcagaagtcaggattctctgtaggctttgctcagcagggaccatggtatgtgaggactgtattagaatcttcctctgaggctagtagtcgtttagagtccttgcaatgatggattaaagtcctttcttctagctcccaaactgggggtgaacggtgggggatgtcactctcactctcagtttttaaagattgctttcaagtttttgacatggttcccaaaggtagttcccagtgttgacgttggctttcttctggccctgcctggatgagtctctgacttctgcagtcagagctggaggaaccctgtgctctttaatggttggtgtgatcaggccaggttcatccagaagactcttccctttccgtccggtgaagtgtaacagtgagaggctcatcgtagtcagagtcccacggacttgaaagctatacagagtggaagccattggaagtcatgttacaatttgtctagcacagatggacagaaaacagtagatatttgcttcttaaggatgctcattgcagtgttaattataacaacaaaaaaaattagatgtcaataaagggccaattaagtacaatatatgagtatcagaaaggggtgtcggaatacagagttaggaaactttatggagtccagtctttgcttcacctcatttatgtggatttccaaggtcgatctcaggtctgcaggcttacacagcaagtgctttacctgctgagtcatcttcctggcccccaaaataacctttatagcaatactagaccactgtttaaatattaagggatctgtgtgtgctatatggagagatgcttagatgtgctattagctgagaaaaaccattggctgacttgcacattgtgcacagaagtcattggcactagtgttacttcttgtgctgggtcagaggatcttattttaatgcttaaaatatttgaattactttttgccactattttgaactacttctgtaatttttttcaagctgctaacttaaaaacaatgcaattgcaaaccaagtatttaaatggcttttatttgttttcttttttcttcttttcttttcttcctttcttcctttcttcctttctttctttttttttttttttgtgacagtgtttctctgtaaaacatggctatcctagaactcaagctgtagatcaggctggcctcaacctcagatatctgcctgcctctgcctctgcctcctgagtgctgggattaaaggtgtgtgcccccactgcctggcttaaaaaataaataaataaataaataaataaataaataaataaataaatacaggggctacacaggaggaaaccctgtctcaaaaaacctaaataaataaataaataaataaataaataaataaataaataaataaataaatacagggctacacaggaggaaaccctgtctcaaaaaaccaaaatagatagatagatagatagatagatagatagatagatagatagatagatagataggactgcaggactagtgagatgctgaacacttgctactgagtttgacgatctgagcagttcccaggaagcaaagatctgattcctgcacattgttgtctgccttccacatttgtgacattatatgtgtgtgagcgtggacacacaaggtatgaaagaaaagcataactgtgccagtgtccctgagaactcccaactccttgactatttgaagattttaaagtactttgcagtttctctaacatatactggttttgcctaaaaaattacataatatatataaaacaggcaacaacggacctgggatctgctggatggaagtcagctacttgcacttagagttaagtgagcagcaaggacatggcctgcaggtgccttgctcttcgtgaggtggctgtgctggtttccatttgacagagggttttctgcattgccctggctatgcacagctcattggtttaggctccttgtttggcttggtttttaagggacatttactgtaatttcccgccctgttctccccttttaagccacaatttttatttgttcttttatgggtttggtgctggagagtgaagcagattttgtttgtgatcagtataattggtcctgagtatttttagaagatagaacaatagactcaggaaatgcttttaagttttttattttgcccagaattcctcacctcatgtctcttgtctgctggcgctcagtgtgctcctagctgtactccagcctagtcactccgtctgctgacatactaatgtacacatataaaatgttattcctatatgaggaaagagcacgtatgtgtgttcactgacaggctgatctcgtctgtgggccactgtggcttttagaatcagaaccatataattactgctaagtgatgctcggtggcagaatgtgcagctgcgggcttttaaggagtgtggttttcttgtctcatatcagttttatttatttatttatttttgaaacagttctatttttactttttgctttaagaaagagtctgagttccccaggttggccttgaatttttgggcctcctcttagctcctacatagctgggatcacaggctgatgtcaccagggtcaccaggcctgtatcacatttattcttacttatactgagagacttatttttcaatttctcttgttttctctaaagcacaagaaaatttgagggctggagagatggctcagtgggcactgactgctcttccaaaggtcctgagttcaaatcccagcaaccacatgatggctcacaaccacccgtaatgagatctgatcccctcttctggtgtatctgaagacagctacagtgtgcttacatataataaataaataaatctttaaaaaaaagaaaatttgaataacaaacaaacaaaaaaagaataactgatatcttttgggaggtgtttttaagacaggggcttgttagactacccaggatggccttgaactacctcagtacctactgctggcctcaaacaattagtgggccttctgcttcatccttctgaaattacaggcatgtgttacagagcctggctaatagttaactatctgcctactgtttcttattgttgtgtacttagaaagcaagaagtgtagcgagtgtcttgaccccgtctcatagttttgggtccagatatctcaagaggattagtttgttgttccccaaacctctttttgatagcttactgacaagttccagaaacttttgtaattttctaaaggacacagcactgttctaaagaagaatactgttcgtcacagtatttggagtagcagattggtgtggttagattatggcatatccataagtctagagctgtataatttgttttctttttaactaccaagctgttatcataagaaagacagaattttatcttatccctggggatttctcagctaggctaaagaaattggtttgctaatggcctgtaccattagtccccagcacaggtgacagtggaccctggggacttggggccagagagagaggagagacaaagacagagggggaatctttagtgaatgcaaatgagaattaagaaaatatatgctcaatagctaggttatggtttcttatacatgatgctgacactcaaaacttcctggaattcttttacaattttgttttattgctggccatgggtggggtgatgtttgcctgtaatcccagtacttaggagatgagttaagatcagattggactatatgaaaccttttaactacagtttgttccatcctgttgtattattggcaagagttaaaccttatataaatgtctataatatagacattaatttttcatgaaaataaagctctttaatcagcttatttgaccttttggaatgatatattttagtatttaaattctatttaatttaaacttaaaaatagtggtgggcatagtggcacattgccagtaatcccagcattctagaagctgccagttcaaggccagcctgagcttcatagtaagatcccatgttgacagttcacagaatgagggtataaacatttgggagagcacttgccctgcattctcaaggccttgggtcccaaccccagcaccatagtttggaagagtctgagagggtagttaagaatgtggatgtgacttctctgccactgaagcttgcagttatgagcactgcgcccagttttctccccttttatgtaattgtgtgttatatttatatgtatgcttatgtgtgtgtctgtgcctgctgctctcagagaccaaacaagggcatctaatatcctggaactggagttgcataccattgtgattcaccatgtgggtgggtgctgggaactaaacccaggtcctctggaagagcaatgagtgctctctcttactgctgagccatctctctagccccagtgctccttcaatcttacatggtagaaacatgtctgtctggaactcagtcatggaaatttcttccctattgtgtgggttttgaggattgaaccctggctctatggtagagcagacagtgctctaacagctgaatcacctctccagttgccttcctcagtttttaaatgaacatgggaatgtgcctacttcatagagattctgcgaaatgatcacttaacacatagttataaccattgtgtgccaggtgtaaatacacctctatcctcatagcatcatgacttatagggattatcattcccattatatagtcgggaaaacacatggaatggaagcatttgctcaagattccaagctagaaagctaacaaccaatctaaggaccaaactaagagagttaggttacaggtcatttatctgacaactgactggctcaggcatttagctcacggatatatactgtggtcactatacatgtaagtgtacttgctatatacttatagacatgtactcatcagagaacattagaaaaaataggactggccaggtgtggtggcacacgcctttaatcccagcacttgggaggcagaggcaggcggatttctgagttcgaggacagtctggtctacaaagtgagttccaggacagccagggctacacagagaaactgtctcgaaccctgtcccccccccaaaaaaaaaaaaagaaaaaagaaagaaaaaaagaaaaaataggactatggttactgtctctagtctaatccctcggggaatggtagcataggacggcctgtttgcgcacatactaatatgccgtacatgtcttttcacctgatttggcttttgttctcctgttttggtttacagagtggctcggtactctgtgcatacttgctgtctctccacagatctggcattgtttggaagtaagctaaggactttttctgagtcattattaggatgaaaggcatactagatgatggtgtggaccatgaatgccacttagactcttacctatactcaagtttaggattcttataaaggaattttaattgacattggtaacaaaggtgattctgcctttggatttttaggaggaaatatctagcactgaccacatgttaaagattctttgtttgcttttattttgaacagatgttatactcacagctggatctgcttttgaaatagcaaagtgaggctgtaactgtaaggaggtgcatccctgcacaaactgagctcatgttaaagttagatatgctattgaatacagtcttaaccgcctctgtgccagtgtgaagagagccctcagattccattaaacccaaacctgagtccctcagtatcagccacaaagagaatgtctggattgttatgagagggaggccttctcaccttcgtttatactttcctttgttttgtttgtttgtgtgttcgagatggggtttctctgtgtagccatagctatcctggaactcactttgtaaaccaggctggcctctaattcacaaagattcatttgctcctgagtgctgggattaaaggtgtgtgccaccatgcctggctccagtttacagtttcctatatggactgtagggtttccttatgtatactgtcttagtcttctctactagcattcactctaaaggcacagcttgactttaaatccaaggtcaactgtataatctgtttgttactactctaacaaaagacctgaagctgtgaaccttataaagaaaagagctttgtttagcttatagttttggaggtttcagggtatgataccagcattggttttgaattgatgaggacttcatgttgggagaacacattaaagagagagagaacacacaaggccaaagattagagaagagccctactggaagaactactgagtgtctcacatcttccttctgagggcagtgcccccagtgacttcccactaggctccacctgttcaggtttctcttcttaaaggtttaccctgtgtggtaacatcccacactgaaacccacacatcccttgagagatacattctagtcatagccacaccataacaccaagaaggaaaatgctggttttttttttttttaagcccatctttagagttcttacctgttacttcatgtctttttcttcctagagaattgtggcacacctacaatctgcccacttaggagtatttccttgtaccatagttccaacttgacaaccacatcaaaatataaaatgcaggaactcgagagatgtctcagaggataagagccctggattccctagaacagaatttaaggagaattgtaagctgccatatttgggtacagctaggtaaagcttccagcacccacataacaacaggtagctcccaagtgcctgtcatccaggtccagggtctactgctgcttctgagggcacctgcacagtgcacataacttaggtagacatacacaaataaaaaataaattcagaaatgcaaaacagtctatgtctatgtaaagtacactagagtagtaataattttcctacacattttttaatgtaagggctggagagatgaagctcttagtggctaagagctgctcttcaagagaggacccagatggcagctcacatctctcctgaactccagttccaggggatccagcactcttctggctacctccccaggcatgtgctcagtgcatgaacacacacacaggcaaactactcatacacgtaaaaataatcttttttaaaaacagaaaaaaatgagcccaaaggtttctgatacagaaatagttttcagtactgtggagacagttccacatggggtggggctgggatctactttgcctgggaagccccagggatcagcaatgccagcattgtttgtaaacgcttaatggcagaatttgaggatcctaaaaggaccctcaggagcctaaagccgtaaccttcctccaggtaaatgatgctcactaataagacatgggcagccacctgccttatcagatttcctgggcaacagagctagaaagttaatctaaggtcatacttatctttagaaagggaagagtgttcggttagcccttgtgtgcaactctaaaaggacattttctctgggacagggtcttcagacttgcctgtaaccagtggcttccgagctggcttcacctggttagtctcttcagtatggcactgttcatcccctgactttgtcctctttgggtaggtcggatcaagtattcagagatggtgtacgatgcgtgcatgcacactttcgactgtcttcctcttgctgccctcttaaaccagcagtttctctgtgtacatggaggaatgtctcctgaaattacttgtttagaggacattaggaaagtaagtaactttttactattttcatagagtgtgcttttaaatttttgttctttatcttagccagtgactacctatataacatatagcaattgctgaggttaaatgaaaatacagtcagaggtagaaatacgggactgactcataatcttgtcactgtcagagagctgttagtaacacttggagaaacattctttctctttttaaaaattaaagttttgtttcgttttttgaaacagggtttctttctataattctcgctggaattcactctgtagatcaggctggccttgaactctcagagatctacctacttctgcctctgagtgctaggattaaaagtatgcgccaccactgcttggccttaaaattaaatcttaatagctaaaagcatactcttcttacagtagaactctgaaactttaaaaatcatatttgtatattttaaacaaggtctctctgcaaagcccagactagccttgaactcaagacagttctacctcctccactgtatggtataattacaggacttgtgccaccatgcccagctttaaaaaattaaattatattccagcttgcaaagaaagaacatgaatgtgaagccttggccaggccccttacccttggagtacattctttctgtaaatgaggaaatttgactgagtgccctgagctctggcagctgtgaggcgcactgccgtttgcatcctaaacaggatggttggttgctccatgtgccttacactcccttatgtggtagttattcccaagactgtgtcttcatgactgagggaaaggagcagccttgtgcacgtgcacttccgcaccttgatcccctcagttcccacggggcacagactcaggatttccttgagttcacagcagtctcccagtgagcagtgagccggtgtgtgtgtgctggcttttcagtacccacccagcatgtcgcctttagtagattttgtatttaaccactgtgatcagctgtggtaaaaagctcccctctcactcagcagaagccctcttcttgactctcagatgttctggtgtgttcaaaaacaattatttatattctttgatttttttgtgggggtgtttttaattaaagcagcagtaactgaaaaagtaagttaatgacaaatattaaaagtaagttaatgacaccactgcatagaatggaaagaataaaaggctttttacaaaagaagacatctctattagaacgaagtgagcagtggacaggatgcctgcctggctccccgccctcctgtagctctgcttcccatagaaaatagaatttaactttagtcgtcacaattttttgtggaggctgatttcacatttgaggtaaatttcactagattagcatgggaggagaggcccttttctacaggaacagagataagatacttgtacacatttattgacgaattctcattttctcaagggaccatccttggggctcacggcctcatctgcaatactttcctgtagggagaaggggacttttaatctgctgcttccaaaagccttttactttcctgatttttttttctcttcttttggcccttgtgtgtcttctagttagataggttttctgagcctcctgcttttgggccagtgtgtgacctgctgtggtctgatcccttagaggactacggcagcgagaagaccctggagcactatacccacaacactgtccgaggctgctcctacttcttcaggtaagctgagaacacagtgaaacaaactgggccccattttactttttcagtttttctttaattacatatgtgtctatacacatgaatgcaggtccaagagagagactagagacataagatcccctgcagctggaaatataggcagttgtgaaccacccagtgtgggtgctgggaacttaggtcttctataagaagagcacatactcttaaccacagaggcatctttctagcccactgtgatccatataatggaattattcttttctaaattaatttttttttctttatgaatgttgtatctgcatgtctgtccgtctatgtactaagtgtgtgcctggcgccctctgaagttagaggagggtattatatccactagaactagaattctggaatcaccatgtgggtgctaagaactgaacttgggtcctcaataagagtggtaagtgttcttaaccaccgcgccatctctcaagccctagttttatgaaattaatcttgccaccacacctggtattatgaaagttttcttaatggctcaggtctcaaacaagaagtagagactactgtttagtctcattctctgtgttcttatttctcttttttctctgtcccctctctcacctccttctcctcttcctttcattttggtgttggagagcaaacccaggaccttacacatcctgggcaagcacttgttcaatcccttaatagcaggaaagctttaatatgttcttagacatgagatcataagaagtacagattagtgaacacagttaaaacctctcccagtatctcactgttataagctctaaatgatttattatttgtttctagatatcatctagatacttcctaacgatctgacttttaaaagattttatttctttattttattatttctatattttatagctgtcttcagacacaccagaagagagcattggatcctattacagatggttgtgagccaccatgtggttgctgggaattgaactcaggacctctggaagagcagtcagtgctcttaaccactgagccatctctccagcctcttatttttatgtgtgtcggtgctttgcctgtctgtgtgtgtgtaaactacatgtgtacctggtgcttgtggagaccagaagtaggcatcggatcccttggatctggtagttacagatgattatgagccatctgggacggggaggggtgggggctgcaaacgaaacctgggtgggtcttctgcaagaacaggaagtgctctttagcactgagcatgtctcctccccctccctctctctttccctctccctccccccctcttttttttctctctctctttctctctctctatgtatgtatgtatgtatgtatgtatgtatgtatgtatgtatgtacgtacatacgtacgtacgtacgtacataatcccagtatttgagaacaggcaggctgcacaatgtgagtccaaggccagcttcatctacatagtgggtgccaagccagccaggcctacgctcttagggttactgttactgtgacaaaacactatgaccaaaaagcaagtttttttggggggggggcagggagggttcatttggcttatcagatcacaatccatcattggagtaagtcaagacaggaactgaactagggctggaacctggaggcagctgatggagagaccatggagggtgctgcttactggcttgctcccagcttttggaacttctgctattgaccaaaacaaaccaaaaccaaaaccccagaacactgatccaagcctaggacttttcctggaagttattgtcctaaagttcacatgtgagctcttggtatggtttgccaagcctaaataaataaataaataaagtagagaaaataaagacattgaaatctaaactaattttaattccactgttttattatgacaaatttagttctttaaaaatcttgctaactggttaagataatacagtaattaaatgatacatatgtataaaagaagccttaatttgcccctaaacatttttaaaataatcgttttgaattctactctgccatctatctttctagtgacttatttactgaaacaatttaacttttccctcttatgatgttgcttaaggacttagcattattggccaaatgtcatttgttacagttcctgtggtcacctgccaacacctcttacaacacaggccttccacccagaaattctcctcctaacacttggcttgcagctatccccatactcacctgagttccctgcatcccagtccgtcctcacagagctcttatagcattggtggacacacttggcagaacaacagatgcacctgagccagcccatacggcgcaggcttacagctgacattagaagtcatgcgctgactcttgtttttagtctttttttctcttttgttttacgtgtaggagtgttttgctcacatgtatgtttctgtaccacatgtcttcctggtatccatgggggccagaacccctagaactggaattacagatgtgggtgctaagaaccaaacccagatcttctccaagagcagctcttaatcactgagccatctctccacccccacctcacagttttgtttctgtttctgcacttttctgtcagcagtctttttcagtgttgataatggtatcacacaaagtgctgtccagtgtccgtgagcaaagcagactgtagtgtaacttacagagatttgtcaagtgtgagttgtgttcctggccatgagttcaatgttaatgattcaatcttatatttacataaaatatcattatgcaagaaaacatcggaaacacttaagtggttgatgaaaatatggccagaggctcctaggaatcttaaacctcatacggaacctaggaacaatgtctcatggcatgaatccttggccgtgggctctaccagaattccacagcctcctacctcattcctaaggccttctcaaaactgcttcacagtctatgaatggctaacagaccattcattgttcctatgccagtcaagagggggacttcctgttccgaaattgtgataatgtcatatataggtgatcttaaaattatacattttccactgagcatagtaaaaagaaaattgccccctttttctcagacaggatcccgtgcatcccaggctggtctcaaacttactatgtaggaaaagacagccttgaacttctgcttcttctgtctcacctcccaagtactggggttacatgcgcagcatccctaaaatatggtgtataggggttggaccccggaatttgtatgctgcacaagcagtagaccagcttagttatatcccaattcaagaaagaaatactttctaaaagataagtaagtaacagctacaaattctgatggtaattttatatcctagttcttcctggttgtcaaacagaagttcaaaaaaaaaaagaccattttaggagtatatgcagatatcattagagtatggtggtctataatatttatatctactcctgagatagccatgcatagtactatcttgctattgatattacatataaagttataagtagattcttttaatttttctaaaggtttgatgatttaagaaaagcatgcactaattttgtaggacctactgtatacacatacatgcatacatggagttgtgatacatcttcgtatcaaaataccaacatttttgatcctaatactagtagtgttaaggtaaaataaattaaaagatggagaaactttctattctaaggtgtcttcttcaagtttgatagtagtgtgaaatagaaatcactggtttctgagcttttttttttttttttttaatcgaaattgaatataatatactcgacagacagacatagagtgtttttcctctgggctggaggagttactcattagacctgcttcctgtcctctcaaggattctcggagaggcctgggtttaagacgctctgaggagggaggttgtgagggaggagctggtttctgagcttttaataaaagttcagtcgtagggctggagagatggttccgtggttgagagcactggctgtttttccagaaggcctgggtggaggcacaatgttattgtgcagtgtttgaagattatccatgtatttttcaagtgctgatttctctgcctccacgtctggttgcaatcctgacatggcattgtaatacttactttaagactctcctcctgcctctgtgatgtgatgctccttattgattctctggtctgtcaataaaagctgatcagccaatgattgggcagaggagggaatggggctggacttccgatgccagccaggggggagggtcgggggaggggagaaagggcgatgggaagtgggattcactcagaggagagggagggtggaggggaccttgagaacacacctggagctgagcgacccagagcagtgctaaaatacaaggatcttgggggttcgggctgggagggagccagaatattttagaggattaaaacagattaatattgaccagctattgtggtgtaaagcttgattaaacaagacttacagtatcatctcattgatttggaagctagtcagggtaaagaaaaaaattatcactctgatggctctaacacctaggttcagttcccagcgctcatggtggttcgtaattgtctgtaactccagagtcatgggatctgccaccctcctttggcctctgtgggaactagaccctcagatggtgcatatccatacaagtaggcaaaagcctcatagaataaagtaaatctttaaaattgcagagtccatagtctctgtaatcttaaaacaactctcagattgggtgttctgtttcttcctattaaaacataactgctataattccatatttaggtttttctcattttctttttcagttaccctgcagtttgtgaatttttacagaacaacagtttattatcaataatcagagcccatgaagcccaggatgcggggtaggttgcacttagacctcaccttcctgcagattttacttttagtgtaaaaatgcctgagttcatatctcctttttcaggtaccgaatgtataggaagaaccaagcaactggctttccgtcacttattacgattttctctgcccctaattacctagatgtctataacaataaaggtaaagaagtccagcaatatcttagtgtgaattgttagtaactgtgagctctactttaattttgtgttttattttattattgtgttcatttgcttatttttattttttggctctgtggatggaacccaggtccttgtgtttgtgaagcaggcactctacccctgagctatatcctggacacctatttttaagtacaaaattcagtcagataagaaggtcttgggtaaggggtgaggctttgtagtaaagcatgtgtttagcatggggaaggccttagcgacactctctggtatcttactctgctctgcaccagctccccaagaatctgacatctctacctctctctccccaactcctcttctgatttgttctgttttgagacaaggttttgctatgtaatgcagactggctttgaacttggggtcctcgtgcttcatctcccaagtgttagggttacaggtatgcactcccattcctagatgaagaagagatcttattgggaaaaaaaggtcagtaagtttagaatgtaagctgctgcttgtccttcatctcctgagagattaggctctttgggagcatatttgtttagtattttaaaatgggatctcactgtacaacccagaccagcttcaaactcccaccctactttggcctccctagtgctgggattaaacatccaccatcatacctggctctccattaggtgggtggttggttggtttggagacagggtttctctgtgtagccctggctgtcctggaactcactctgtaggccaggctggcctaaatttgaagattcacctgcctctgcctcctaagtgctggggttaaaggtgtgagccaccactgccccagttttgtttcatttaaatctgagactgagagctggagagatggccctgtgttttaagagcactggctgctctttttacaggacctaggagaagtttcaggggacccaacaccatcacacagacatgcatgcaagcaaaacaacaatatgcataaaattaaaaataagttgttttttaaaaatctgagactatccttcagtggtttttctttctcttttaatcttgtgctctgttaggacctagagccttactcttgttaggaggtattgggcgctgagttccactcccagccctgatcactcactccataaaaacagatcctccctcccctagccttagctttatcagctttatcaactgctccaggctgtcctctactcctgactgtccaactgggctctgcaccacctttactgtgttctcatttcttttccctagatttcatgggtattagcagcttgggtttttttttttttttttctagtttcctttcttatcaagtatacatactttgttttaagcatcctcaaggatagttgtgcccctatgcctcgttttgtgaggcactctcttccttctccctttttagcaccactgttgagatcatctgtggaaagccttggggctcccagtgtgcttagctgagacctgcactcacatacgcacttgctaataccttaccaagaaatacctttattttattttgttttatacatattttttgagacagagtttctctatgctgctctggctgtcctggaaattactatgtagaccaggctggcctcagactcacagaaagctgctgctgctaacttccaagtgctgggattagagacatatgtactaccacccaacagtttacaaatgcctctttagttctgagaagaactctcgcaccttcttcctcctatggctgcttttcctgtcatttgttttcttatttttttgagacctaggccagatgacctttgaatttgctttgttgtctacaatggccatgaaattctaatcctcctgcctccattccagaatactggaattacaggcatgtgccatgtctgacatctgtggtgccaagcctcatgcatgttaggcatcgctcttcacgctgagcatctttggagagatctttaggctcattggtacccaggctgtatctttgttccctgatgacctaaaacatccttaaattggggtttttattcttatttctgtctccccaccccctatcccctgggaacatactccaaaaatttcttaagcttccatttttaatcatccactgttgagactaacttctttttcctgtgacagaattactgatatattcatgtcagctatataaaatgcacacagcatgaaaataatggaagtgtacatgtcaggtaaagttaggctttcaacaactggaaatcctgtttgtgtgtgctttatagtagtctgccatattcattttagaccattagtaacttaaagtttagaacactagtctatcccacagcaaggaaacaggaacccaatgtgaccttggtctgtcatttttaaagaattgtgtttcatgtctcagtaagaataattgaaagaaagccaggtgtagtggcacatacctttataatcccagaacttgggaggcaggaggcaagtggattgcttaaattgaagaccagtcagggaattcctgacagctagagctcttgggtggtggtaagagaagagaagaaaagagaagagaagagaaagagagagagtgtgtgtaaaaacaaaccaacaaaaaaccctaaccaaacaaaaaagaataattgaataaatagtacaaataacaacaaacgagacagaataaggaatttttaaaaaatataaagaagccttttccccagccccctcagcagttggttaggggctgcccctcacctaaggcaggaaggtggtggctgcaaagacacaaaagtttctagccagatgacacaggtctctgattccagcactcaggaggcagaggcagaggcaggaggatctctgtgaatttgaggccatcctggtctacagagcaagttccaggatatccaggagtacacagtgaaaccctgtctcacccacagtcacaggtctctggtgtttgtcaactctgggctcctgtttgttataaaaagtggaaagtacacgctgaggtacagactctgaagatgatcagacagagccaagcaaaattggttatcttcaataaaaactgcccagcttgagaaaatctgaaatagaatactatgccatgttggccaaaactggtgcccatcacaaaagtggcaataatattgaattgggcacagcgtgcagaaaatactacagagatgcatgctgggtattattgaccctggtgatgctgatattatctgaggtaccagaacagattgatgaacaatgaacaaggaaagctttgccagagctcatttaaaagaaagtatacagaaaatcagtaggtatgcatctatgtgacatggttactgtcagctgtttatagacactcagaatgctgagaatagaagacacttttttaattgattgagattctacattctacccttaaacattaattataaattattttgccatttattgcactgtgagttgataacatcttggagtgtttataaaaagctctagctgtggctcatgacttgcaaaggagtctccgtctgttcgatgggtaatagtgctatttgcccttagaaattgtgactgttaactggccagtaaatggaaattatagggagttttctatgttgaatctgaagtttcttcagtagctagtgcacagtaaacccttggtttttcaaagagcagtgtcttctgtgttttgatgatgtgaattccccaggtgtctttgttcccggtgataattaatccccaagagaatgaaccctttaaaattctttaaacttgtcaggctgtcctgaatttacaaatggaaaataagtcattgaaaagtcactgtagtaggctcacagggacaaagcacaaagctgctatgctggggttctctgtgcacacatgtcttgtgtgtttactttttagctgcagtgttgaagtatgaaaacaatgtcatgaacatcaggcagttcaactgttccccacacccctactggctcccaaacttcatggatgttttcacgtggtctttgccttttgttggagagaaaggtaagagaatccctgtgtgcatctgaacaccagctctcttctgatgagacacctttatattcccagagtttattggaaatgtgtgctaattttgtttgttctctacaaagattttaaaaatttttacttataaaaaaatctgacttgtgtgtgtgcaggatgtgtatgtgtgcagtactgggtgcaggatgtgtgtgtgtgcagtactgggtgcaggatgtgtatgcgtgcagtactgggcgcaggatgtgtatgcgtgcagtactgggcgcaggatgtgtatgtgtgcagtactgggtgcaagatgtgtgtgtgtgtgcagtactgggtgcaagatgtgtgtgtgtgcctgtgtgcatctgaacaccagctctcttctgatgagacacctttatattcccagagtttattggaaatgtgtgctaattttgtttgttctctacaaagattttaaaaatttttacttataaaaaaatctgacttgtgtgtgtgcaggatgtgtgtgtgtgcagtactgggtgcaggatgtgtgtgtgtgcagtactgggtgcaggatgtgtgtgtgtgcagtactgggtgcaggatgtgtgtgtgtgcagtactgggtgcaggatgtgtgtgtgtgcagtactgggtgcaggatgtgtgtgtgtgcagtactgggtgcaggatgtgtgtgtgtgtggagagggaagaggactacttcgtggagtgggttctctcctttcacctttacctgagcttcagggattgagctcaggtcaccagatttacataggaacaccttgatccagtgagccctatacagagatttttaaatggcattaatctgttcataaatattagtctattatggtttttctttatgtgaaatataaatttaaaacaactgtcttgtgtgatcaagatcttaaagtaatgtggccactattctatctcttcaatgaattatcagtgctaacagaatgtagactgaacttgttacagaggttcatgtgcacaatggcacaagtaagcagtacaaacataaaacacacttacacaactgagctgcgcaacgcaaacagacccacaagtgagcagtagagacagaaagtgagcccggtgggtggaggcccgttgtgatttctttgtaaaatggaaagttttatatgcatatctgagccaaaggttctgaacagctatgtaataaaatcaagtagttctgtgatagactccacaggttcttatccagccaggacaagtgtggacaaaaattctctctggggctggagagacggctcagtgggtaagagcactgactgctcttccgaaggtcctgagttcaaatcctagcaaccacatggtggctcccaacatccataatgagatctgacacccctcttctggagtgtctgaagacagctacagtgtacttacatataataaatacatttttaaaagaaaaaaagttctctctgaaccttatggtctacccttggttctattttcatagctaattataatgtgataagttgtttcggtctgtgtttacttaatgtattttaacttatgcacatccagaagtgtcctattaattgtgcacacactgtgttatttgccacttagtgacagagatgctggtcaatattctcaacatatgctcggatgaagaaatgaacgtaaccgatgaagaaggtaaacttcttactcaaatagaagctgatggcttctgatttctttttattggttttggtcttactagaaaagacttatgttcattgtaaaaaaaaaaaaaaaaaaagtttgctgagcagtggtggtgcatgcctttaataccaacacttgggaggcagaagcattcagatttctgagttcgaggccagcctggtctacagagtgagttccagggctatacagagaaaccctgtttcaggaaaaaaaaagtttgataactataggaaaccataaataggaagaaaatagtcactattgttctgccatctcaaatgtctgccatcaatgcctatgtgtaaactgtctttatctttacatagatcttttttcttctcatttttgtcacttacaaaaatgaggtgacatgctatcatgtctttatatctatttcttgttttcctttatagtctagtttttcatggttacatagttgtcacattcatcaatcactgtgctaaccaatattatagatgctgctgggtattatattttcccccacaactttagcttttaaaactgctacaatttgtcaccagatggaagaggcacacaccataatcccagcatttaggaggcagaggtagatggatctctgtgaattcaaagctagtcttggtctacagagtaagttccagagctacacagagaagccctgtcttgaaaaccaaactaaaacctgctaacagtttcaaatttgtatagataaatcactgctcattctatcaacagccagactttgttatatgcctgatgtgtgccaaatattgtttatgcctttcttcttaataaacatacattgtactatggaagacaaacaagaaataaatacaatgcagctactaatgcatgctatggaagaaagtagtgctgtattagtaactctgagagtaacatttacttgtttacttttataggttaaatgtctagaaactgcaaatatttcagtatttaatgcttaatctgatacagatagcatttttgtttgtttgtttgttttgttttgtttacacagggtttctctgtgtagccctggctgtcctggaactcactctgtagaccaggctggcctcaaactcagaaatgcgcctgcctctgcctcccaagtgctgggatcaaaggcatgcggcaccaccaccccatccccaccccaccccacccccgcatagatagccttttaaagtctatgttactctgtatctctttgtgtgtgctacatagttcataatgcttttcctagtactgtttattttcttattgcagtttacacacacacacacacacacacacacacacacacacacacacagagtgctgtagctagaacccagacattgtgtaagctagactagtgtttacctctgagctgtatccctagccctaaatttttaatttgtacttttatgatgactaataattgcatttttcttatgtctattgaccatattattttctgttttgtgaatgtaaattcatatattactagtttttcaactggatcctatgcatgttttgcttcctgtttgatatgtaagagatcttcgtgttgtgtcttaggatagtaatgctggttatatgtgtagctaagtgctttttttcccttctgatttctatcactattaattagtttgtttcctttagaagaattaagtttaaattaatttgtagccaggtgcttctagtgtgttgtgagtggtttgatctgaaaggtatgctctaacttgtctgaggatacaggagtttttggggtatggtgtcacatgatcacagacctccagttcatattctttgcaggtctatgtagttcacttaactattgcataaagtgttgtatggtggagaactcatagctcccactgggagtctagaggggattccaaaacatatgtgttattagattgtactgggagattataacagatggattatagcttatatcttctggataggaaattggtgaatggggcctgtccttttgaggaaatctgaaaggaactttaaaaagaacatagggaaagtaaaatattttaaaatggatttaataaattttatatgcacatctaaatagaaattgaaatggttgtaaactatgatctgtgttaagaaaaactttttgggcttgtgagatagcttagctgacgaaggctcttgctgatggggctgatggcctgagccccatccccaggcctcatgtggcaaaggaaacctagttctcacacattatctatgacctgcatacacaggctgcacagtgtgcacttggttctttcttctcaccaggtgggctctaaggctctaactcggtccagctttttggcaagcacccctacccactgagctgaaaatttgggtttttaaaaagtaatacatcctaaggacttctacttcagccctgcctgttaagacaactagaaaagttggacaaaatgttttttgaagttggttggtggcagtgcacgtccttaatcccagcactggggaggtagaggcaggtgaatctcttaagttcgaggccagcctggtctgcagaattccaggacaaccaagcctacaacagaggaaaaaccctgcctaaaaacaaaacaaaacaaagcaaaacaaaacaaaacacaaagttttatgaatagttttaagtccacatgaaagcagacaaactagtaaagaattacaaggtgagaaatgaaaaggtcagaaacgcagacagatgaggtagtgagaccatgtcttgagatcattcatgaatttcaaaggagtgggtaaaagggttaagaggaatttttataactttgtgtactaatcttaaaagaatgggctgaggactcccaaggagggtatatatgaatgtaagtttctgttcttgggacctcagagggtgactctgcaagagcaagggtgagccaggtggagatatactatacagtctctcgtcatcatctcagcctttggcatcaagtactccctggtagaaagatctctgtgaaataacagcatacaacatcccagtaggcagtctgtcaaatacagtgcattggtgacaagcaaaaataagcaggcacgtggggagctaacagcagaatgaggaagagaaagggttcccagaacagggctggcaggatggctcagtggtaaaggaacttactgcataggcttcacatattctagctttgacttcatagagctagtataagtctctgtccactgtgttcacactgtggcatgatcctccccattacgcatactcaggcatgcgtgcgcatgtacatatacataagcgcaataacaacaacagaaataagattttaaaaagttccagccaagcatgttgtcatacatctttaattacaccacttaggaggcagaggcaggtgactgtgtgtgtatggaatatagaagttctgggcagtcccaagatacataatgagactgtcacaaacaacaaagaattttcacagggcgtggtggcgcacgcctttaattccagcactcgggaggcagaggcagatgaatttctgagtttgaggccagcctggtctacagagtgagttctagggcagccagggctacacagagaaaccctgtctcaaaaaaacaaaaacaaaacaaaacaaacaacaacaacaacaaagaattttctgaagcagcagaaattaaatacagaccctccatagctctcaggcattggctttgttaagccaaacttaaagcaaagcaaaatcataatttgtttttttgggagattgactggcctggaactcactggcttgaaacatcacagagatcctcctgcctcagccttttgagccctacgattaagggtatccctggcttaatttaagaaattaaaagaccgggttaaaaatgttggtagagaattgtgaagtaaaagaaagtgtagcatatttgataaagcatcaaaagtgaaattatagcattgaaaaataagatgacaaattagcaagtttgatgcagtgagacagggactaagtgacctggaaggtaggtcagagcaaagctaactgaagcatggtgagaagggagtgcagagtcagccaagagcctcagaacacgcgctgccagcccagcacatggtgcctggagtaccagagaaagcgggaaaggcagtctctgaaaggtccacatcaaagcaacttccagaactgagaagacacggagctgtaactgaagaagccctcagcagagcaggacagacactgacaacagcttctagcctcttgtagtgaggtccacaagatggaagatggatctgaaaacagcttccaaatgggggtcacccctagggaagccgccgccgaaaagcaggttcttcatggagataggggagcagggctggagtaacacaccaatgtgtgaaaactaacacccagtactccagagtccagcacacagcaaatgtgtaaacaagaaaggccaaataaatatttgtagatacctctccaaccctcacatttactaagaaaattagcaggaaatatatactaaataaaattctaaaggacagtatttaagcagaaggaaaatccaagaaagaagtttagaaacacaggaaggaatgaagagaagtagagagcgcatgcacagacagtgtggacatggattcttgtcatgcttgaacaagcagagcatgtgccagtactatataagcaatactgggatgaatgcattcaaaatgtataggcctgaaaattctgatcaccccagcacctctgcatacatgataagccagtgttctgaactatagccccagccgttagccttatacttcagtacgtaacaaactcatagtgcaatctctaggttcagctggcttacaggttcagaggttcagtccattatgattctagtgggaagcatggcagcatccaggcaagcatggcaatggaggagctgagtgttctatctcctgttcctaaggccactaggagactgacttccagggagctaagatgagggtcttacagcccatgcccacaatgacacacttcctccaacaaggccacacctaatagtgccactccctgggccaagcatattcaaatcatcatatctctgataacactagcttgtatcaaggtgacataaaactagtcagtacaacctagccttgattgattctaaacttcagagggaaatggctaaagacttaaagaactccacaggagggcttgctctatagatgtcaagatttaatataatgctacagcaattaagatgatcaattcaagggtagctaagcattgaaacacaatagagaatccagaattaagctacatgtatatggatacttgattttatcagaggtgaaattttacaatggctttgtttgtgtgagacctcagtgtatagctctggctatgctggaactcactatgtagacaaggctggcctttaactcacagagatccaccagctctgggattaaaggtatgtgccaccatacctggccaataatggcatttaaaatactttgtagatatctacttttgaaaaaagtaaatcctcgtggatttattttgtggatccaaaatacctatttttgtgactatatttcattctgatctgaaaggtgcggaggctgggggtatggctctgcagtgcagtacttgcctagcatcctgaggtcctggctgcttctctagcatctctacatcacagcaacaaacaggccagtaacagccaagcagtgatgaattcctgtctctccagccctcacgactgtggcaagagaaccacaggctgaggccagtgtgggttatgtagtgagttggaggttagcctgagcttcatagagagtccctgtctcaagaaacaaacagcagaagttttttaaaactaaaatgtagggagtggggagatggctcagtggttaagaacactggcttctctttcagagatcttgagttcaaatcccagcaaccacatggtggctcacaaccatctataaagggatctgataccctcttctggtgtgtctgaagacagctactcacatacaaaaaataaatgaataatctttaaaaaaaaatctgaaatgtaaaacagtggattttgtagtatgtataatacagaattaccttgataactgtgcaatggaaaaaaatcctttaaacgggatgcaaaaaacactagccaccaagaaaattattaataaattagataaattgaaagcaagagctgggactggagagatggctcagtgactaagagcacatgcagcttttgcattcacatggctgctgccaactctggttccaggggtcttaatctgaagccttctctggtctctgagggacctgaatgcactcacatgcatgcaggtaaaacactcatgcacatatattaaaactaaaataagctaggtgtggtggcgcacgcctttaatcccagcacttgggaggcagaggcaggcagatctctgagttggaggccagcctggtctaccaagttccaggacagccaaggctacacagagaaaccctgtctcagaaacaacaacaacaacaacaacaaaaccaaaaaaacccaaaaaacaaaaaaaataaaaaactaaaatgaaggtaagagcttttgcttattcagagattttgttcagcatgtgaagtggcaagacatccagaaggatgggatatttgcagtacaagcaacaaacagcccattgacaaatgactgaattattcccaattaggatgatgtggcatgaataggcacctcagagaatttcctaatggctaacaaaaatataaaaatatattcagccccattagtaatcatgaaaatgcaaattaaaattataataggataatactctacttatcagattagtcagacttagatgagccatatctagtgttagccaacagcacatgtagtaacggagtgtccacatacagaagtaaaatgttatagatcccactctaatagacagtgctaaatgttgtccaaagttaaacatacccatgctctagagatgagcattctaatgtcctaggaacatgccagaaatgtgcatatgtgcaccaaagacagatacatacagaaatacatacagagcctcacatgcaatagccaaaagttagaagcaacacaaatgattactgttgtataggaatgaattgttgcatagttgaccaggcctgatacaacttttaacacttgggaggcagaagcaggcacatctctgtgagttcgaggccagcctggtctacttagtgaattctgggacagtcagggctatggaaagagactgtctcaaaaaccaaaataaaacaaaacaacaacatagtggcacagtgctatggtggggcagtgtgtgataatgaagatgggccatggtgaaaataagagtgtgtcttactgagatattgtcaccccagtgctcaattgtccaactatatgaaacccaaaacctaaaacctgggccactgagattattaattcaagggttgatgaacccactgccaggcctgagcaccttagttcagtgtctgggacccacatggtggaagaaaagaaacaattcttataagttgtcttctgacctccttgctgagtacacacaaagagaggataaataaatatagcttgttaaagaaaacaataaaaaccataagtgcgccgggcatggcgcaagcctttaaccccagtacttgggaggcagaggcaggtgaatttctgagttcgaggccagcctggtcttcagagtgagttgcaggacagccagggctacacagagaaaccctgtcttggaaaaccaaaaaaaaaaaaaaaaaaaagtaagtgcattcatccataaaattaaaaagacaggaagaagatagttctagtgaaaagcaagggacttatgtcctttggaccggagaggctacagtggtgaggtactatgggttgtgagcaacactggtattgccctgggtgactagttttacaggtatgtgccttttaacaaatcatgtcatgactagtttgctttgcataaatacagaaaacgtgtgcttcatagtaaaaaggtaaaaattacatgtctacaaatagaggagatcgaacttttggaagctgagaaaacattcattggcagtggtcagtggggagcgaagcaatttagaagatacataacaacagccctgaaaatgccaggacaaaaatctgctaatgcaaagcagatttaaaaaatattaaaaaaaaaaaagaaccccagaagatcttctcatgctgtaagaaaaacacatccaacgttaagatctgtctagggatggaacaaggtaacaggtgacttttaaatgtgttagtgtgctcacttagttggtttgggaacactaaagccctgtttagtgctagggaatgctgaatatcagtactagttgctagaactgagaataaaagagcaggcagggacactgcgctcactcaagtaaaataggtgagaacctttgaaaaaactgttaaaactctgcttgccatgggatacatgtccctcttctaagtctggaggctgatctccaaacgtaaaggcattctggactgtagatgacaaaggagaactcatgtccctaacagaggaccagcatgccatgctcagagccgtcagctgtctttttcccccgctctggaagtttgtgattccctccaagtcttacccatgagcaaacaccaaggaccatcagacccctaagcaatggccttacaagacagaagccacagaaaacaacttgaagtcctgaaggcttaaactttaaacctctaggaaggaaaatgtctactgacaagtgaggcatgctagcaagtcaaacagcagcaccgtgttcctgctgagagatctgtgagctattctgtcccacaaacagtatctttgtgctattttcatgctgggggtggggtggaaaatagtaaatgggaattaatgtgaagggtaaactattaagcaatgggaagataggacaaaactgggaatctgtatttagtcttggggagcaagcagtctctgagctgctccgctaacagcctgcatttcacacttggatttttttctcttccatgtaaactcccatcatcctcccatgtgtctgtcttcatctctttatttcttggtgtctcttctccctgaagatcactacatttcaagctgtccaaaaggtatccaactggaatgcactgccagctaagttcttgctgtctgctctgccactggtgattggttagtcgtcttgacttggtagtgggcagcttcacgtgactttccaccctccccctcagtgggaacggctgtcttctgtagacctgttgtgtgatttagctgagtggagaggtaggagagaggaggaaagcctgtgtagctttgtctgacttttggatgctattgcctggtatatgcctgaatcttatctttcatgtttgggctatttcctaaatctttaagaaaaggccataaagtcttacattaacttacattaacagtgttgctttttaaaataccttacccatccttgtaatctttgtggcacagttgttagtagtattctgaagaaacacagctggctggtataagggaggaagactgtagaaagagcgtggccttcctaagttcaggactgctgctgcctttggcagaccagaccccgcatccaaaggtggcgcgtagcattctcaaaggagatcttggcttgtaggagcaagtgctctattgctgtgagctttgtttgtgtctttgtgtttcattcctcaccatgtttcagaatatgaaacctcctgctccccatagatgactcggagtctttctgtgacctcttcattctccccttcatttcttctctcctgctgatttcttcttgttctttgcaacttcccaggattgttaattgtttttttaaaaatttaggctttgtttctttctcttttctttttttaagtttttctttaatttaaacataaaagcactccatcttgcatttgaaaagaaaaacctgtcctgttaatcatatcactttaacccacttgttctttgtattttctaaggagctactacaggtcgaaaagaagtcatcaagaataaaatccgagccattgggaaaatggcccgggtctttacggttcttcggtaaggttccatcgttacactgtgggatgagggtgtttagaaaggaggttacaagttagcttcacagcagtgttttcaaggattcagtctgatgctggaactgcaagtcttctggttgagtgcaggttaaacagactccctgtgaaagtgacagcattgggaacatccatgtggtagtggtgtagatggagaggtttagtgtggattttagaggtagatccccatgttcaaactctggctttccttagctgtgttgtcttgggtttaatgtttgggtcttagattttcttgtctataagctagagattaaaatagaacctagctcacatgttgttagtgagtcaaatgggagaaagtgtggggacgttgcctggctaccagtgcctctggttgaaaaaggactggttaatttttgtgtctgaagtgtatgtagaaacctggtcagatgaaggtggggcctgtcttcctgtctctgtccctgttaccttccttcaggtctcattgcgttgctgtgccatggctccctggcattaaccagggcttccatgttcctttgcagggaagagagtgagaatgtgctgaccctcaagggcctcactcccacaggcacactcccactgggggtcctctctggaggaaagcagaccattgagactggtgagtatgaagatgtcccttcctaagaggtgtgcccccattaccaggagttggtgacttttgtttagaacctggtgctagagcaatggatatttaccgagggaaagaggaatcattgtccttatccttcttgtacacaaaataattcaaagtagatagtaatttaggggaaaaagtgtgaagagtaggtattagagtaagcaaagtcttcaataagagacttttattattttaataaaagtaatgctcttaaaagaaaatagaggttattaaaattaaattccccttatgaaaatacataattaagagaaggaagaggcaagccacagaaaagatttctgcactacctatgactgacaaaggccttgtttcaaaatagacaatttatttcaccaaagaagatgtgaagatggccagcaaacatgtatgaagatgcccagcatagttactctcctggaagatgaatatgaaagcatagtgaaccacttctgcatacccataagaatggctggaatgtagaaatctgacgaggtcaagagttggtgtgtctatggaggcctggactagaagtaggctagtgggcttacacatagactcaacacattggccagctggtagccaataaagctgaagacacttggacccataccctgcaactccacaccaaggatatccaagaggaattagcatgcatgtccacccgaggatatgcataagcatgtttgtttactgtggttttatcatggtagctccagatcagaagcagctcccctgcctgttggtagtgaatacattatattatattgatacagtaggctactgctcacccattggacctgttgcattgaggtcaaagcacaagcttagctcctgtccatcagtaagaaagagtgtcactctgaaagccagtgatatcttgaagagttacacatgctttggaaataacatataagtaatccctaattaaagcactgattcaaaccagaaatgaagagacataaaatatactgggaccaagcccaaaaaggagtgaagaaaaaaaaatatgtatatacatacatatatatatatcccaagttactgcacctataaaattctcttgctacccttgatttgtagatttgctcctatgagatctagcaaaaaaattatattaaagcaactttgtggatcaataaatttttaaaacttcaagtaaggaagataggtaggcatttctctttttttcttaatccatgttacttcctattaacctaaaacaccctcatcagaactgttcacagaaaatctcatatgactaattaacaagtaaaataaaagtagttaagtatcttatatttttaaaagcctgtacatttctttagagatatggcctctaggaggtcgaccatccttcagaggatagttcacagccctgtgaaagagactaagtagattcagtgagttattaaacaacaaaaaaggagaggacatggagatggtgggaggtgggtatgatcaagatacactatatatgtacaaatgaagatcctgcaaccatggagttgagggtgcattggaaatactttatggacctgagagaggactcagtgggtaataaaagatacttattgccaaagttgatgacctgagtttggtcccacatggtggaagaagagaactatataaaagcagaaaaaccagccatatacataaaataaaaatcaacctaaaaaaagttaaccacagtcagtggtaactaagataggtttgatgatgatgatgaagtcagtaggtagctggatgtggctgcatgcttgtaatctcagcacttgagtggcagacatgggaggatcaggaaggagtttgatattctagctacacagcaaatttcagggatggcctggcctatatatgaccctgcttaaaaaaaatcgttttaaggattaatgagagcttcagtgtctgtaataaagctcttgcctggtgtgcatgaaacttttggtttgatccttaggactggggaaatgacagaaaggaaggaaagaaaggaaattgttgatgagattttagagaaatgaggtcatcctgtgctgcttgagggaatagagctactgtagagagaacattgtatcagttcttcagatgactaaatagagtcaccatagattcagcactgccaccctacacggccccctccagtgagagaaataaactatgtcctcaccaagacttgtatatcaatggtcatacatgacactttcaaaagagcctcacatggcattcttctgaacaccctaaagtagatgcgacttcagtgttcatccattggataacaaagtaaggtctatacagtgggattccacatagccataacaagaaggaatgcactcatatgcatcaaggctaggctatactgcatagtgagttccacgccagcctagcctacgtagtgagagcctgtctcaaaacagcaaaaatagtgacatacacacttgaaacaatgttctagcataggaattatatgtaaacagtttcataattttttttcttaccatgtcccttggtacatacagactgcatcttagtaaccaatgcaaaaaacagttcagtgagggccctaaaattttaatactggaggtctgtagagatggctcaacagttaagagtacttatggtctttgcaggggacctgaattcggttcccaaaaccacataatagctcaaagtcatccttgcctccagttccagggggtgtgacatcctcttctgatctccacatatgcaggcaaaacattcagacacatgaaataaataaatctagatttttttttttttgaaatgggatgctggtatatactttaccacacacattcaaactccaagtaaaccaccactctccgtagagttttagacggaactctggttcccaccttctcacagctgcagaggcagcaccctgctctgtgagaggtgctgtccctccttgtgtggcttatctggcccgtctgaggtcagagagactacagcagtgctctaacaggagccttcctaggggccattgcaggcacatgggtgctggccgccagatcctgctcttaaattgcagtgggaggtgaaggagcttcgcagctctctctctctcatagtgatgaaggaaacctcacggtggtcttgctgctgagtggccttccttccttccttaggaaagttgcccttggaggagctggcagggctctaatgggatctcattgctgtaccctggaaccatttcatgtgttacagcttgactgcctgacagaaagtggcagggggaagtttccctattggtgctcattttaattgcttccatttctggcaccggaagggagaagattgctttcttagtaattgacctgctttcttgcacaaggaaaagaagccatatgaggtgttagcgtgagcctctgccatgtcctgcatctcagatgggtacaaatcaattagagttcaaatcaatgcctagctgttcacctctagaccagaagtaactcttcacttataacctatttttctccccttccaaatgctagagctattcaagtactgtcctattcttttactattgtaattattaaatggttaaggacagttaggtcatgcgtaagtcatttaacaatactaagaagcaagattaaataggatttttaaataggactgagcaacagctcgattgatacaatctgagcagttacaagctcaaacatagttgtgatattaaattatctgatttaacaagtcattttgatgtgtgatgatcacaagacacaaccagcagttgatgatttcaaattcccatgccaacaggagtgttagaactgttagtgcctccccacctcatgcgcatgctcctgaggtaatcccctcccttctctctctgggtgggaccctggctgctttactgtcagttcactcatcctttctctgtcttcatttttgtatgcactgctcctgccttcttacagccaaacaagaagccgcagaggagcgggaaggtatggccatatccctcagccggaacacccctgtgtctgttcaccagcctccaagcttcattggcatgtcggaactcactagcatctgcagaaccctgacaggaaaggagaggatggccctcagggtggccacatgccagcctgtttctcagatggccatcacacagcctgtgtcctttctaagtctgtcagttttatgtaatgactgaagcttgtgcagctggtaatgacagaggtcaaatgatttaagtggttcctttctttattaagagagttaccgccgggcagtggtggtgcacgcctttaatcccagaggcagaggcagagaggcagagagagaggagaggcagagacaggcggatttctgagtttgaggccagcctggtctacacagtgagttccaggacaggcagggctacacagagaaactctgtctcaaaaaaacaaaacagacagacagacagagagagagagagagagagagagagagagagagagagaggagagaggagagagagtgtgagtgtgttacctggggctggagagatggctcagggattaagagcactaactgctcttccagaggtcctgagttcagttcccagcaaccacatggtggctcacagccatctgtaatgggatccgatgccctcttctggtgtgtctgaagacagcgtactcacatatataaagtaaataaatctttaaaaaataaaaataaattttaaaaagagttacccaataactcaaaggttagcaggagtttccctaagacatttcagcttagggtattttgtttctatggagacattttaaatcatactgcttatgaatttttagataaaaaccattggaattcacaaatctgcaatgtagatttagtaatctcattagataaggtgattcaaaggggaattcattccttggcaatacaaagttgtatctggttggaacagctcagtggtagaatgtttatctagagtatgtaaggcccagggttcaaaccctggtaccacaataaaaaatttcagtttaatcagatgggaagtatctagaagctatgttgatgtttttcatctgtgttcagctcctggctgtgaagataaaaagctgtttgagcagataggtctcctgtcacttgtgcatggctaatgccatgtttgtgcttaaagcagctatctgtgtgataggatgtgctttcctggtgttgccttttctaaaagtgagcagggttttcataagaaacttaacttccaagtgtgtggaggccaattaacacctaatcctttttatttctgccaggacttgttatacttttctcttctcttctctttttatgatttagttatttgttttacttacctgagtatactattgctctcttcagacaccccagaagagggcatcggattccattacagatggttgtgagccataatgtggttgctgggaattgaactcaggacctctagaagagcagccagtgctcttaaccactgtaccatctctccagccccaagacttgttattcttatggtagtttttaccacacttgagctgcttagaagcagtgtttgtgaacagagctgatttagccacgtgttgcctgtcagcagatgtgtgttctgtagctgctttcctgtgcgttcctaggagattgctgtgtgctgggaagcttggtttaagctgctaactttgccacctctctgagcacttcctaccccctcctgtctttctgcagccatcagaggttttacaattgcacacaggatccgaagttttgaagaagcccgaggtctagaccgaattaatgagagaatgccaccccgaaaagaggcttcatatcatcatgatgcagggaggatgcactcacactcgcatccgccacacccacaggcgtcaagaaggaccgaccatggaaagaaagccctgtaatgactcagggccctgtgcagcacagatgggtcccaaccctatgagcaaatcacatttatttatactggaaatgaaacaggaacaactcaaacaacttaaacttggaggtgcatttgtaattcagtcgcatttattctgtaagaaaaatgaccattttataaattcttctaatttatgttcaatatatatatatatataaaatacttttgttttgtttccctccccttgtcctaattttaggaacgaatctgattggttgggtgtgtgtgtgtgtgggtgtgtgtgtgtgtgttgaaatcttatgctataaaggggaccttcccctaataataagggccttggaaaccttcaccctagatttctgactcatactcctagttagccctcttcttgtttggggaggtgatttttttttttaatttatgacataactcgaaaatgtctttcaatagccaggcgtggtggtgcacacctttaatcccagcacttgggaggcagaggcaggtgaatttctgagttcgaggtcagcctggtctacaaagtgagttgtccaggacagccagggctacacagagaaaaaaaaaattgtctttcaaaatttcccttctgctcagtaccaatctcaatggctaaaattgcttctcttctgagggaaacttggacttccaagagaacagcccaaacctagtgatttttaagatccaggtggaactgcttccatagtaatttacttcctttcggcttctgagctctgtgattgtagagtgtgtgtgtgtgtgtgtgtgcgtgtgtgtgtgtgtgatacataagattgaaccaggccttgcacatgctgtgaaagccctctactgccccgctgggcctccactcctgggttcatgttaaaaagtaatcatcagggtgggctagtgaggttgcttagcctgcttacttaagtctgctccccaggaagaagaaaaccaacttacaaaagtcatcctctgaccttcacacaacattgtggaacaaacaaaataaacaagtaaatgcaataaaccttttaaaataataataatcctgagaggttttcttagacctgcttaaagtcacctcttcagctgttgccagattctttgctttcagtttctaaccccagatgaaccaacccattgtgaacatctctggaaggtcctcaggacgtgagcgctgagatctgtccttgtccctctgtgtcagcacgtcaagcatggcagctgctttcccagcattcttctgttttcactgtcagtgtgtctgaaaaaaaattctcaggtgttggaacgggctccttgtccactgaaccttgctaggcggtcagatgagtgaaggcctctgctcctacagttaatcaggaaactccttcccagtgtcaggtcattaggctgagccctggagccttgactagcatagtttggaacccaaaattagggattcatatttaattgccccttagatttttttttttttttttttgagataagagtctgattttgtagccctcactggcctggaattctctctatagaccaggctggccttgaactcacagagctccaactatctgccctgtgagtacccggattacacaaccacacccggctttgtttgtagtttttgagtcagggtctcatatagtccaggccagccctacacttatgaagctgaggctgtctttgacctcctgattttctcctttccatcctaagtgtgggcaccactccttgttgggctttttaacttttagtaggtgatgagggttgtcttatgtgtctgtcacctttgacccagtctggttgtaggtgccatggtccagtgttcactgatggctttctaatgactgctggagtctgggtacccttgatcaaagcttggaaagggtagatttgttagccctctttggtgccctgtgggatgtggaggtctagcactaaaaactaaaagcaagtatctcagacaataatataacaggttgagaagttcaggggaagcagaaaaaaacaacagtataactttttctttttaaaaaactgattttcatgaggaacatgaaaggttagcttgcctatctgtggggttttttggggggggagtgtgtcagggctatctgaactttggaactagagttagatgtggttgtgagaccccatatgagtgctgggatcgaacctcatactggttacgctgagtaacgagtgctctgaactgccaagccatctctctagccccatctggtttttgtggggttttattaagaaatacttttgctaacattttacagtttgtccatgacagatcagagagtgttttggaaccttcctgcgtggactgctttgttcattagagagaagaggtgcgatggtgacggcccacagtcccagcactggggaggtggaggcaggaaggtcagtatgtttaaggtcatccttagccagggagatggctcagaagggagaaatacttgtcacacaagcttgatgacccaagtgtgacccatggagctgactcaggaaagatgtcctctggtttccacacaggagccatagcatatgcatgcttgcactcacgaacactaagagtgatcataattaagggctagtgagatggctcggcagggggagaacttgtcttcatgtggggatgatcccaaatcctggaactcactctgtagaccaggctggcctcgaactcagaaaatccacctgcctctgcctcccgggtgtgccaccacgcccggcaagagaaagggtcttaactgtcaggagaaaacctgaaagaggggaaggaaactcccgaggaaggtcgtctttattgtcatttctttgtagcttatgctttctctccccccaagcccagtggtagaaatcatcctttctttagaaacctcacctatgaaagtcacagtagatcgtattgtgacacagtccactggtggaggcccctcactgctaaggacccataagaaggcagaagttctgaaagtccctaggaaccagaaatagttcagacttagtcttaggaatgtgttgaaataactactgtttcttctctttaaacttcattagaagtttttcacatcttttcagatttaaaaatctgaacacattttcctcctggttcctccattgcatttgccctagaccagctatttctgcttagggccataactccttttttaaagtagttggtttttttgttttttttgtttttgttttttggtgttttgttttgttttaatgtgcattggtgttttgcttgcatgtatatctgtgccagggtgccatgatcatctggaattggtgttatgggcaactgtgaggtgccatgtggatgctatgaattgagctaggtcttctggaaaagcagccagtcatcttaactactgagccatctctccagcgccaagaacccatttctttctttctttctttctttctttctttctttctttctttctttctttctttttttctctctctctctctttctttccttccttccgtctgcccgcctttctttctttctttctttctttctttctttctttctttctttctctttccttctctctctctttctatggttttagagctttattgtagaaaggcagagagaaagacggtagaaagaaaaagagaggccagccatggccacgtggagagaaggggaaagggaggaaggtagggctagagatgagaataagaaaggtgagagagctaaagaacccaagtgattagaatcagactccctaatgtgtgcatccatggtatgcatgtgcacgggtgggctgcttcatagtctgaaattatgcaaacagcttccagttttctctgaaatctcaaggtgacacctcatttgtcactagacattgatgataaaagtatacatggcttgtctcatgatgtggctcgttgcctaggaacaggggtgtcagactgtccaggaatgtcagcattgctcctgcctaccactgtctttcattgcatcatctcttcctccagagtagcttgctagccagtgaacaagttcctctcactagtgaacatttggttttctaccctgataacttaagaatggtttcctgtcgggcatggtggcgcacgcctttaatcccagcactcgggaggcagaggcaggcagatttcttagtttgaggccagcctggtctatagagtgagttccaggacagacagggctacacagtgaaaccctgtctctaaaaacaacaacaacaaaaaaaccttcagtacaggggacagagaaccccctattggttcagtcaatagaaaaatcatttgctatcattaagagcgaaggtaggatttctgaaaatggagtcgcttcaagacttcttcagccttggcattatcccttagttccttttctccgtgtggttttcaaacccagagtctgagacagctggtgtaatataagaaaaatactcaagtcatgtgagatgcagctgggtgccccgctttatagccaattatgcaagaactctctagtctacaaatgcggaagtaaaaatcccttctctctgccttatgtaaatcttctagctgatctcccaagcattttctgtatcatatctataaatatctgtaaagttcacactctagagaaacaagcgcatgctggccaatctcactggccacttacttatactggtttaggaaaatcctgcctcacattgttttcttcacattaatgatcattggattcctctgcccaacgtttgtgctgaaaatgatttcctaaccagtaaagacttgctgaggtagcactctagaaccccagtgtttaacctagctgttatggtaacagtggaactcagggggttttgctctcagttttccctacccaggcagaaaagaattccatagcaggagtggacctagaactcagggttgggtatgaggctccagtgtgctagattgtgtggttttaccttatctgacacccgtcctgtctttcctgtagcctgttagatcagtgtaaagagcagccaagacagcaagacactgaagagggtttgggtcacacagaggaatctctttcagttcttgccatgatcagaagctcatagggaagccgtaagaaagagcagatgagtgtagagaagaaagccagtttgccgaaggacaggagcagcgctctcatctggatgccagcaatgcgctgtgctaacaatagggctctgtgccattggcagtttgagagagggaaactacatgacattgggacttgggagctgtcctgcctctatctagccagccagagtgaatggggtcagtgttaacggccttcatctatgcagtcacaaaggtaaagatgatactgggagcatattccctcctgggaggccttggcctcacgcctcagcaactgtggcaagacgtgctaaataacacctttgtttgagccagggttatgcatcgtcaacaatttcatgccaagtctaggtggtttcagatcaagcagcagggacgtggacatggaccatccctctgtgcagctctgaagtagagccaagcacactgcctgcctgtaagtccctgcccacattccctttaccccctttcacagttctccaagtaccctccctgtctttctggtttggggggagggggagcgtatcaaagtgaagtgcacatgactagatgtaggtagccagaacctatggtttggggtgataaagatgtgatctgggctgggcacatgacgaagcaaaagaaccactgcaaatttgagggttgcctggtgtcacagtaaatggcaggctaatcagggctacataatgaaagcctgtgtttaaaacaagagaaaagggaaatgtgtttttgtctgtcccggagcctttgcaaagatgccatcaggagccccttatgttcattcctcccagcatcctaagccagagctcttttccccatcacccgacccttcctagaggattggctctctgtgtcacttcgtagatgatgaagcagtcagacatgccgatgtagatggtggctcccttgaatgatggcctattcgctcgtacttagaggttacctgcgttctcctgctttctgctatgttaaagacaatcctagaaatgttacctctcaacaggagacattagtctttgtgaataagttttataagaactttcttactatacactagaagtcctcttaagattaaaagaagcaaatgctcttataagtgaaggataacttcattgactccctgtgtctttatttccttgaattcttagtagagggactgatctttaggctctgacccagttagtaattccagcggtgagggaaagcctagtttctgatgtctggtctgatttctgacaatgccagtaagtcccttcacaagagaggatccctcagccttggttaaagctcagatggcctctgatgagtttctgcttcccaaccctcgcccgcctgcccacccaccctcctgcaaaccctgtttcctttgcctcttacctcttcctgaaattatgcccaccacgatctcctgccctagaccctctgcggcctttccagcagaggcccctccttgaaggagtagaaggatgataacccagaaaacagtctttacaaagcacaaaaatacattttacgatagtcatttactaagttttcatatgatctgggaaaagtcagaagctcaaagggagttgatgaaaagctgtactcctaagcttagcagtaccagaacagccttggagtcctctgcaaagcaaacagatcccagggggctgggaattcacaagagcagataagcatggctgcacagtttgggggtggagacagggaaaggctgaggccctggacagggacttggaaagattatggcaacagaggtggaaaggctaaatccaggtctgctgcatccaaatagcaacattgacatcaaatacagccacagtgtgcaattttaagaccagaaaaatgagcccggattttttaactgcacaaaagccaagtgagcattttatgttgttaccccagtgacatcctgagttaacagtggccttatcccttagctaaagccccagtgagatgaggtaatgtttgcccttatttcagagtcgtgggaagctgtttcagagcctaggaaagaaggatgagacactgagtcacactgacccctgctagattgagatctaatccctactttgttgtctgctctgggtaattagatggcttcactccttcttcttcttcttcttcttcctcctcctctcctcttcctcctcttcctcctcctcctcctcttcctcctcttctgcttcctcctcttcactttttaaaagatcacaactcttaagattttatttgcaaagcttactcttgatagtgcattggtcacttagaggtaaattgagtcttactgctaatacagtggagacagacagtttatcatagaactcaaggaggccagaagacaggctagcctttgtttggatagcagcactctatcatggtaccctctggccggccagtcagctctctgactcccttatctcagtttccctgagctgggatggaaggctgaggccgacccaattttccaggccctggttctttgcccttgtctgtggctgacttgacttccattccctctgagggcatcactctgcaaagtctgctttctcgagacctgtcacctacttgctccttccatccttttgtaagaaccaaaggaagcctgtctaggttggtccttctcaggcattcctgtctggccatggcatctgtttgtttatccacgaaaagggacgcatggtggatgtgatgtcagtcagtgtccaggcctcctggaggacagactggataaactgggcaggaactgattcttttcactgcctttggggtttagatgccaggaaacatgagatgcccatgatatgtgtgctatgaaaatatttgctcaaagcaggcctgaaatctccaggctcttgttcttgtggggttttacatacctgtccttgcttccaggtctgacattgacctgccttgacctgccctgtgtttttttattgttgttgcttcccttagagttccttcactttgcagtgactaaccccctcccccccccccaaaaaaaaacctcagacttccagatagaccagtgtgtaagagggcccttggagccccaaagtgggtcatttcacttccctcccttgcttgcccctgttctcatgagtgattggcataggtgggcccattgatagagcttagttggcagtactgccagacctggaatcaggagatggccccagggatgaaacagagtcgagatctgtgctagtatatctatggtgacttggcttcagctcctcactgctgggttggttacggactctagaagagtccgtgtgttcttggctactcccttctgatctgtagaaagagaacactcttctaagagcacaaaccaaaaaggacatgaaagcctacctcaagaatgtactgaagtttgtcctagggaaggaactagccggtgcctttctaccgaacaggaaggtcaggcctgcagcagagatgtcagtgtctcatccaaatgctagactgtcctggacactaattgtgattgagactaattggtagtcacttgactaatggtactttgagttggtggcggaggacaagaggactatggggctgaggggtgggggaatgtgcataggacagaattggctgcctggggctgggtggggctcctggtgactgggatcagatagctagaaaaaacagagcagttacgtaactgtgtttacatgggctcaggtggctgtggcaaccatggcagtccttgacccaaggccatgctggaggggtgcaggcagccgactactagggaaggaggtccctcttgagcagaagggtgtgcaggagacagagcatggcatactgaccagggctgcactatctgggacaatgttacctggctctaatgtgccactggaagctactcagggtgaggcaggcaggcagcagccagctacagctagggggaggggtcaggaaaccagacacctggctctctaagtccagtctctgaattcttgctacatttttctccctaatcttcttaaaagaggaagaattctccctaaatctgggcagaaaagagggcaggagattatttaagtttccttggacttacctgccctgcggtcctagcgcctcgtgcctccgtgttttgtaaagccatccgaatacttgtgaacacagtgagctccaacctgagaggtggcgagccagccccggcctgactgacaaagcagagctgcagcagttcagccctccattgccaccctccccgttcctcccaacctacatcctccaagactgtttactagactccccatccccatagagatgggactggtagccagtcctcagctcccttgcccacactgtgccttctcttgtgagaa

SEQ ID NO: 1584 - DNA, 1964 bp, Mus musculus
gttgtgtccctcagccgcggtcgccgtagctctcgacgcggtcgtccccgccgagccgcggcgccgccgcagggagggagcggcgctgcggcccgccgcgtccgaggacgccccgtattccggggccggcacgtggctgccgctcgccgagcgcagcccgcctaggaggaaggcggcggcttgcgtccagcgggccgccggagccgggaggagaccatgtccgtgaggcgccctcagttctccacgaccgagcgcgtcatcaaagctgtcccctttcctccaacccgacggctaactttgaaggaagtttttgagaatgggaaacctaaaatggatcttttgaaaaaccatttagtaaaagaaggtcgggtggaagaggaggtggccttaaagatcatcaatgatggggctgccatcctgaagcaggagaagaccatgatagaggtggaggctccgatcacagtgtgtggtgatgttcatggacaattctttgacctgatgaagttgtttgaagttgggggatcacctagtaatactcgctacctcttcctgggtgactatgtggacagaggctatttcagtatagagtgtgtgctgtatctatggagcttaaagattaaccatcctaaaacattgtttctgcttcgaggaaatcatgaatgcaggcatcttacagagtacttcaccttcaaacaggaatgtcggatcaagtattcagagatggtgtacgatgcgtgcatgcacactttcgactgtcttcctcttgctgccctcttaaaccagcagtttctctgtgtacatggaggaatgtctcctgaaattacttgtttagaggacattaggaaattagataggttttctgagcctcctgcttttgggccagtgtgtgacctgctgtggtctgatcccttagaggactacggcagcgagaagaccctggagcactatacccacaacactgtccgaggctgctcctacttcttcagttaccctgcagtttgtgaatttttacagaacaacagtttattatcaataatcagagcccatgaagcccaggatgcggggtaccgaatgtataggaagaaccaagcaactggctttccgtcacttattacgattttctctgcccctaattacctagatgtctataacaataaagctgcagtgttgaagtatgaaaacaatgtcatgaacatcaggcagttcaactgttccccacacccctactggctcccaaacttcatggatgttttcacgtggtctttgccttttgttggagagaaagtgacagagatgctggtcaatattctcaacatatgctcggatgaagaaatgaacgtaaccgatgaagaaggagctactacaggtcgaaaagaagtcatcaagaataaaatccgagccattgggaaaatggcccgggtctttacggttcttcgggaagagagtgagaatgtgctgaccctcaagggcctcactcccacaggcacactcccactgggggtcctctctggaggaaagcagaccattgagactgccaaacaagaagccgcagaggagcgggaagccatcagaggttttacaattgcacacaggatccgaagttttgaagaagcccgaggtctagaccgaattaatgagagaatgccaccccgaaaagaggcttcatatcatcatgatgcagggaggatgcactcacactcgcatccgccacacccacaggcgtcaagaaggaccgaccatggaaagaaagccctgtaatgactcagggccctgtgcagcacagatgggtcccaaccctatgagcaaatcacatttatttatactggaaatgaaacaggaacaactcaaacaacttaaacttggaggtgcatttgtaattcagtcgcatttattctgtaagaaaaatgaccattttataaattcttctaatttatgttcaatataaaaaaaaaaaaaaaaaaaaa

SEQ ID NO: 1585 - DNA, 1542 bp, Mus musculus
atgtccgtgaggcgccctcagttctccacgaccgagcgcgtcatcaaagctgtcccctttcctccaacccgacggctaactttgaaggaagtttttgagaatgggaaacctaaaatggatcttttgaaaaaccatttagtaaaagaaggtcgggtggaagaggaggtggccttaaagatcatcaatgatggggctgccatcctgaagcaggagaagaccatgatagaggtggaggctccgatcacagtgtgtggtgatgttcatggacaattctttgacctgatgaagttgtttgaagttgggggatcacctagtaatactcgctacctcttcctgggtgactatgtggacagaggctatttcagtatagagtgtgtgctgtatctatggagcttaaagattaaccatcctaaaacattgtttctgcttcgaggaaatcatgaatgcaggcatcttacagagtacttcaccttcaaacaggaatgtcggatcaagtattcagagatggtgtacgatgcgtgcatgcacactttcgactgtcttcctcttgctgccctcttaaaccagcagtttctctgtgtacatggaggaatgtctcctgaaattacttgtttagaggacattaggaaattagataggttttctgagcctcctgcttttgggccagtgtgtgacctgctgtggtctgatcccttagaggactacggcagcgagaagaccctggagcactatacccacaacactgtccgaggctgctcctacttcttcagttaccctgcagtttgtgaatttttacagaacaacagtttattatcaataatcagagcccatgaagcccaggatgcggggtaccgaatgtataggaagaaccaagcaactggctttccgtcacttattacgattttctctgcccctaattacctagatgtctataacaataaagctgcagtgttgaagtatgaaaacaatgtcatgaacatcaggcagttcaactgttccccacacccctactggctcccaaacttcatggatgttttcacgtggtctttgccttttgttggagagaaagtgacagagatgctggtcaatattctcaacatatgctcggatgaagaaatgaacgtaaccgatgaagaaggagctactacaggtcgaaaagaagtcatcaagaataaaatccgagccattgggaaaatggcccgggtctttacggttcttcgggaagagagtgagaatgtgctgaccctcaagggcctcactcccacaggcacactcccactgggggtcctctctggaggaaagcagaccattgagactgccaaacaagaagccgcagaggagcgggaagccatcagaggttttacaattgcacacaggatccgaagttttgaagaagcccgaggtctagaccgaattaatgagagaatgccaccccgaaaagaggcttcatatcatcatgatgcagggaggatgcactcacactcgcatccgccacacccacaggcgtcaagaaggaccgaccatggaaagaaagccctgtaa

SEQ ID NO: 1586 - DNA, 96595 bp, Homo sapiens
gggactacaggcacgtgccaccacacctggctaattttttgtatttttagtagagacagggtttcactgtgttagccaggatagtctcgatcgcctgacctcatgatccacctgcctcagcctcccaaagtgctgggattacagacgtgagccaccgtgcctggcctatatagtgcttttcatataaaattgcagattatacattataatataccttttgttttgtgtagctattttagaaatgctcattttactatggtttttaaaatattctacagttctcttacctgcatttaacacagaagttgaacatttaatggcttcatataaatagaaactgacgccaggttactttcacacaacagtggaaacaagggttccctgtgcttttgttaaattaaaagtgttcataattatgtctcagaggagctggtcattaatcaaggtttaggaagcgcttagggagtttcatgaggaaatacaccaaagctcacaagccctgtaagaaggaaacccagatttgaagaaatgtgtagaaatgatagttaaacatgaatcttggttatttcaaatatttatgtcttctgactgaccaatgcagaaaataaaaaaaagtggggggatacaaaattcaccaagtggacatctggccaggtggagagatccaccagctgaatgaaattgggctctccaatgattcttgagaattgttaatgtctaaaaacaccaccacacaagcaatgaacttaaacctaatttgttatggaaaacaattgtttgggaagggagctcaattagagctttcttctttttaaattttcatggagtggctctagatgttttgtttgtttttgttttaatcagaaaagacattgagaaagcaatgaatgtttaactctattggaactaggccactaaaagaaaagagcagccggcacggtgcctcatgcctctaatcccaacactttgtgaggccaaggtgggaggatcgctttagtccaggagttccagaccagagtgggcaacataggaagaccccccatctctaaaaaaagaaaaaaatagctggacatggcagtggcatgcctgtggtcccagctacttgggaggctgaggttagaggatcacttgagcccagggagatagaggctgcagtgagctatgatcatgccactgcactccagcttgggcgacagagcaagaccctgtctcaataaataaacatataaataaataggtgaagataaagaaaagtgcttccttctttctttttctttcactctgtctctttctctctgctccttccctcccttctctctctcttctccctccttcctttttctctctctctctctctttttctctctttctttcttttagaacagggtcttgctctgccacccaggctgtagtgtggtggtgtgatcatggttcacttcagcctcaactccctgggtccaagtgatcctcctacctcggcctcccgagtagctgggaccacaggtgttcaccaccgtgcccggctaatttttttttttttttttttgagatggagtcctgctcttgttgcccacgctggagtgcaatggcatgatctcagctcactgcaacctccggctcccaggttcaagtgattctcctgtctcagcctcccaagtagctgggattacaggcacctgccacaacacccggctattttttttttttttttttttgtagagatgggttttaccatgttggacaggttggtctcgaactcctgacctcaggtgatccacccacctcagcctcccaaagtgctgggattataggcattaaccatcgtgctcggccacctggctaatttttaaaaaaaatttttggtaaagatggggtctccctatgtcattgcccaggccggtctggaactcctgggctcaagcgatccttgtgcctcagcctcccaaagtgctgggattacagtcatgagcctctgcacctggccttattttcacctatttataaagcaatactttctcaccacagaaaattggaaagataaagaaattttttttattacaccaccaagtgatggctactgttcacatttttttccttgatagattatgctcagtgagggtatgaattatgtcagttttggttcgtttccatatccttaacacagtgcctggcacacagtccacacctaattcatacttgttgaatgagtatattaatattttcttgaggtcttttatttttaaagaaatggagtcttgctatgttgtccaggatggagtgcagtggctattcacaggcaagaaaatagtgtaatatgacctcaaactcctgggctcaatagatcctcctgcctcagcctcccaagcagctgggactacaggtgaataccactatgcctggcttaagacttttattttatgctttttttttttttttttttttgagacagggtctcactctgtcaccaaggctggaatgcagtgatgcgatcttggctcactgcagccttaacctcagagaccgcccacctcagcctcccaagcaatcctcccatctcagcctcccaagtagctgggaccacaggcgcatgccaccacacctagctaatttttctgtattttttatagagacgcggtttcaccatattgcccaagctggtctcaacctcctgagctcaagtgatcttcccgccttggcctccaaagtgctgagattacaggcgtgagccactgcactcggccatgtttatgtttttgtttttgtttttttagatggagttttgctctgttgcccaggctggagtgcaatggtgccatctcagctcactgcaacctctgccgcttgggttgaagcgattatcctgtctaagcctcccgagtaactgagccagccatgtttgttaataaaaatggggacaatactgtatatatatggttatattttagctttttcacttttcagtatctcctgaggcttttctcatgtcattaaatatttttctaatttaaaatatggtatttcctaactgcatgatgttccattcaatcatatttcatgtaaccatttttcctatatggatgaaatcatatagtagatatcattttgtggcttgcttcttttgctcagcgtaatgtattttagaggttcattcatgttgttgcctgtagcagtaattatttctcttttattagctgaatagtattccattctatggaattttacaattaacatctaaaaaaaaataatgaactgcttataggagggaagctgggtgctcttttccacagcacacatactaaaataggaatgatacagagaagattaccatggctcctgtgcaaggatgacacacacatttgtgaagcattaaaagaaaaaaaaagaaggaaactgagggcagggaaataagtgagaatttacttttcttctacatacttttgcagtatttaatttttttcttttctttttttttctttttttttttttgatactgagtcttactcgcccagggtggagtgcagtggtgcaatctcggctcaccgcaacctccgcctcctgggttcaagcaattctcctgccccagcctcctgagtagctgggactacaggcgtgcgccaccacgcctggctaattttttgtatttttagcagagatgggggtctcaccatgttggccaggctggcctcgaactcctgacctcaggtgatccacccacctcggcttcccaaagtgctgggattacaggcatgagcaccatgcccagcctttaattttgttaaaccatgggcatgtgttacttttaaaaatatatatttaaagcatttaaaaaattctgagagcagagttgggttcaagttgtactttgaactacctgtgtgacagtgggtaagtggcttgatgtctctggactcatttccctcacctgtaatataataatgttggtccatatgaatccttggtctttggcctcttagatactccaattggccagttatcttttgaatcaaactttatctactgaggcatactaaattattacatataaggaatggaggtgattagtgattcattatatccacaaacacctactgagcaaccacaatataaatgggccatgctagaaactggaaatataggctgggtgcagtggctcatgcctgtaaatcccagcactttaggaggcaggccgatgtggaaggaccacttgaggccaggagttccagacagactgggcaacatagcaaggccccatctctgcaaaaaagaaattaaaaaaagctgggcctagtggtgtgtgtctgtagtcccagctactcaggaggctgaagtgggaggattgctagaggctaggagttggaggctgcagtgagctatgacggtgccactgcactctagcctgggcaacagagaagatcctgtctcaaaatacataaataaatgacaatttttaaaaaagaagaaactggatatagtctctgccttaatagtctaggtggggaaaacagccacatgtgaataaataatatcctccatgcattaggtggttgatctgtttacaaaacgctcttggtccacagaggaaggctttacctctacctggatggattaagaaaggcttcagagaggtgagtataacagggctggatcttaagggcatggctgaacttgtgagtcgaagtagagaaggaagggtgtttccaggatataaggatcaaatatccaaaggagtggagccctgaacatatccactatattccaaccccatgcctctgtacagctttgcccaacctaggacacctcccttcctccttgctgttcacatcccatccttccttagagggctgcagccctgaaaaaacatagcaaatggtttcaagtggccggcctgaaagatctcatggggctacggacagagagaagctgtagaggtgagtcagggtcaggctgggaaggaactgttgggccaggttaaagggttcaaactcgatcccaagggcgccagggagccactgaagggagatgaggagcagagtcaatagtcagattttctgtacaaagttgactctgggccaggtatggtggctcacacctgtagtcccagtactttggggggctgaggcaggagcattgcttgaggccaggagttggagcccagcctgggcaacattgcaagaccgagtctctacaaaaaatttaaaaaattagctgagtgtggtggtgtacacctgcagtctcagctactcaggaggctaaggtggaaggattgcttgagcctgggaggttgaggctgcagtgagctgtaatcatgccactccagcctgggggacactccagcctgggggacagagtgagaccttatctcaaaaaaaaaaaaagttgattctggggtcaatgtggacaatggatgaagataagaggtcaagaccaaagactcagggaccagttaagaagctgatgcagcggagggttagcccctattcactcccagcctttatgccctgagaatagctgattctattacagaatcagttgagatggattcccgcagagagcaagacacgttccctgtgtctgccccaaacaacccaaagtcttttgaaacctctactaggatgggaaagcaccaatgcgatgggtgaaggtttctggtggtctcagcttatacagatcaaagcctttccaacctggtttcctcccggagaaatccatggatctaacgccctcttccaaacacagagatagaaagtgaggagaactattaggagcagggctgcaatcccagctatcgggaggctgaggcagggagaattgcttgaaccggggaggcggaggttgcagtgaacctagattgtgccactgcactccagcctgggcagcctgggcgacagagtgagactctgtctcaattaaaagaaaaaaaaaaaagaaaagaaaagaaaaagaaaagaaaacattgcaaaccaatgggaagggatgtattattcaataatagtaatggaaaaattaaccgactactgtatttagatctcaagttggggccatctcataacatccaaataaaatgaacctcatttaatgtgttcctatagttcagtctgttctcacagcaagctctggagcctgagttgtaccacaaagatattcttaccttgaggcaaacttagtctgacctggaggccctgatagccattgcccctaggactgggggagggatggtcataactccttaggggaaggggcgcccattcaacctaaggcaattctctggagaaggggcagcaatgaactgtcagccaccagccctcaagaaacaggcagagtacggtagctcatgcctataatcccagtactttgagaggccgatgcaggaggatcacttgagcccagcagttcaaggcttcagtgagctatgatggcaccacttcactccagcctgggcaacagagcaagacctcatctctctcttagaacaaaaacaaaaacaaaaacaaaaacagcagcaaccagaagatggttatccctcatggtgaaggggatctgggcagggcatccccgcctctgctacagggagggcctattaatattatcatccccatattacaaaagaggaaagcaaggcctgagaagtgaaggaacttacccatgcccacagctggaagtgatggtatcaaggtctgttgggtgtcactggctgttgctggaagactaagcagctattgaaacagaggaccagcaaggaacttggagaaaggcagagctactgagtgaatctccttagaaaggggtggggaaggccgaggcgggcagatcacgaggtcaggaaatcgagaccaccctggccaacatggtgaaaccccatctctactaaaaatactaaaaatacaaaaaaattagctgggtgtggtggcatgcgactgtagtcccagctacttgggaggctgaggaaggagaatcacttgaacccaggaggtggagtttgcagtgagctgagatcacgccactgctctccagcctggtgacagagcgagactccgtctcaaaaaaaaaaaaaaaaaaaagtgggggtggggacacgaagggacagggctgcaagttgctcacaattactttgctaaagccaagctacagaatgacatctggattctgtaaattcatgtataccatgcttgaggactcatgccgcatattccacgtggtgctatagaaaaagttcgtggtgctatagaaaaagttcaggtactgcacgtctcttgacgatgatggtgttcactaagcctcctaccagctctgtgactttgggcaagtttcttcacatctctgtgcctcagtttccttatctgtaaaatggggataatcatataaatggggttggtgtgaggattgaacgagttagtatttgtggggttttttggttttgtgtttgagatagatggagtctgtctctgtgcccaggctggaatgcggtggcaccatcttggctctctgcaacctccgcctcccgggttcgagcgattctcctgcctcagcgtcccgagtagctgggactacaggcgtccaccaccacgcccagctaatttttgtatttttagcagagatgagtttttgccacgttggccaggctggtctcaaactcgtgacctcaggtgattcgcccacctcagccttccaaagtgctgggattacaggcattagccactgtgcccggcctgcaacgttttctttttctttttttctttttggagacagtctcgctctgtcacccaggctggagtgccggggcgtaatcttggctcactggaacctccgcctcccggattcaagcgattctcctccctcagcctctcgagtagctgggattacaggcatgtgccaccacgctaggctaatttttgtatttttagtagagacggggtttcaccacgttggccaggctgttttcaaacccctgacttcaggtgatccgcctgccttggcctcccaaagtgctgggattacaggcgtgagccaccttgcccggcccgcaatgttttttctttctttccttctttctttctttattttattttttttttgagacggagtctcgctctattgcccaggctggagtggtgcagtggcgcgatctcggctcactgcaagctccgcctcccgggttcacgccattctcctgccttagtcttccaagtagctaggactacaggcgcctgccaccacgcccggctaattttttgtatttttagtagagacggggttgcaccgtgttagccaggatggcctcgatctcctgacctcgtgatccacccacctcggcctcccaaagtgctgggattacaggcgtgagccaccccacccggtctttttttttttcttttttgccggcccgcaatgttttcttaaactttttatttttagctatcctgttgaggttcttccagatgaattttagcctctgacccaggggtatgatttgataggcgtggagttctggttacttcttaaatgaagagtttccccaggatatctgaacaattctcttgggtggaagactcaaggatcatgaaaacgaaaaccaaattctagtcggctcctaaagtccttttgcctcctgcggttaccatcaaagagctatggtcaaaattccaagggataattcagggtctgattccactatatatccccagaccgcctatacataaatccatattattggagatttacgcttaatcctataatcttttacctaacagctgtccagtagaattttctggatgtccaataaggtagccgcgtgtagctcttgaacacttgaaatgtggctagtcccctagaggaacgggattaatttaaatttacatagctacaactacttatcggtcactgcggtaattgttaagactggttttgcctgtaacttgcatatgttttattggacatcagtttcaatatttcatttgcattgctaaaagtcaaaatccttttgactttgccagttactcagtgagaggacagttggagccagtttctgttctaggcttacagttttaaggacagataaaggttagtttttaacctcgagatgaacagactgttaagtttctacggacttgcccatggggttccacagtgagcctgggccggggaggcaggtactgtgtcagggggaagaaaaaaggggcttctagctgggcaggtgacacacagggcataggaagaggtcagttcttgtggccgaggaggtccggcccgggggtcccaggagcagagatctcccttctcttcgatgtggaaagtgaggagggagcagagccttgctcagaaacggagctcccccaatcccccaccgccctagctactggactggaactaggatggacacgaatgtccttctcattgtactaactgcactcaacaagcgggaaagatgaagcgagggggtttaaatgtgtgcgtttgttgaatgacccacaaaaactgaaggagcgcggccggactgatcacactccttgagacaaagcgggtgggagacccagaggtgaggagggtggtcgcctgtgggcgaggactgggaggccaggggttctcggcgaggcggtcccaggaggcggcgcggagccgctgcgaggccgcagggccgggtcgcaagatggccgggccggcctcccgcgcgggtcgcgcgggccacgcgggcgggtttcagatgttccgggcccgggtaggggctggcaggagagaaggggccggctgcggggagggctggctgagaagaagcgaaaatgggcggttagcagcagggacccggagccggaggagccgagagcagcgcgtgcgccgagctctactgcctcgcgggaaggcggaagggtggggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaaggtgcctggcgggccgggccttcctctgggacccgcgggaaacggccttcggctgggcggcggctcggggcggagggaggctggggccgggctgcgcccaccctaggagggctcggaggggtgtagacagagccgggcggcagcctccgagagcagccacccggacccggcgttttctgctgcacctggtcaggtgcctggccgtcagtgccaagttccctcccgaagggttcagggtgcagtggggacttcttctcccaccgccccgaagggcccggatccctgtctttttttctctttaagaaacgactcgggggaagccatcgggggtggtgtgagcagggagtcgactcttccaagtaagatatttaagattagatctttcttgacgtccgccccccacccttttttaggacgtataccatgtgccttttgacccgctttctctagatcattgcaagtcactgctattactggaataaacttagtatgaacaagtcagataaatccattatatgatgtttaaaataagtttacggagctcttgacagggtaatggtattttattttccctttggttataaagacttggagaatgacgttttctgattcatatgtgtacctgcgttagatttctgttgttgttataagaacaaaatgtaaagggctctttgctctctaaatcttgtagagttttaggttatagttgtttctccctttaaactaagaagatggattacacataaccactaatttatgtgctgcttttattcagccgtaagtcttaggcacaacccttctctctgagattaacaatcggtttgaaagcgctattttgtaagaagggaatagacttagaccagctgtgttagtggcctctggatgcaggggttagcgtgacagtggggaaaattattaagatacttttcttctttttcattttggtattagaaggagaaaggcaactaatactagtgacgggaatacatttttaaaaggtgaaacgccttattgcatgttcagggagggggaagaattttagtgtataacttaggtttcccccctctctccccaaatcagcctcataaatgttaattatctgtactacataattataatgggatttttgagatttatctgcttagcatttgtatgctatcgttagaggtttaactgaattgttcatctaactgacattatcccctgaacagctaaattattgtgaccatttaaatgtgtcttcatattattagtgtatagcctataagaagtatatagccctctcttaagattcagagtgtacttaacataaccttttttgaggaatcaaggtcattatgtacattaatttctgtactgtgctgttaatatggccggtgcgttctgctgtataaagttgttagcagtttcgtcctgtactaaaatgacttcgcaatgctataccagttcagtgttttgtttgcttttagtttctctctccagtactgttttctgtcaaaatatgcccttaactgctttctaatctgctacgtcttagctgaagtaggcagggaaaccagataagccagaactgtgggtcaagtcagaataaataggatcttagtgaagcttagtgcagccctcaggaatctcacaatcaaatcaccattgtgccatgtaatttccaccataacatgccataagatcaaaagaagattaaaaatcttaaatgacccttaaatatagtaataaatattgtaaaataaaatgtaataaaataaaaaagttaaaatgcaggggctaggggcaggcatggtggctcacgcctgtaaccccagcactttggaaggcccatataggcagatcactgaggtcaggagttcgaaaccagcctggccaacatggcgaaactccatctctactaaacatacaaaaattagctgggcatggtggcgggcactgtaatcccagctacttgggagtctgaggcacgagaattgcttgaacccgggaggcggaggttgcagtgagccaaaatggtgccactgcattccagtctgggcaacagagtgaaactctctctaaaaaaaaaaaaaaaaaaaagcaggggctggtttattgctacgcatgcttattattaaataaacactgtcatcatatcctgcaggatgcaaatttgttctttaccaaaattaattaccgaatattgtgtacttttaagactgctcttaaataaatgaaatagaaataatttcaggtccttagaatgtatggatttctctcctatataaaaacttcggcataagagcttgaccacagcatttgtggcttcatgatgacttatggtgcttttttcagggttttccagagtttgaaatagttgaagaaaatgaggtgtcacgtgtgcatagctaaggtccattgtaacgggtactaaaccctggtctgatgctatcttgtttagtcacagctgtctgcatttattcacagcttgaaagctttttcagaggtgataccacaccccagctatttttgtttctgtcatttcctgttaactttaaagtgtacctaattgttctatttgagcaaattttggagaagagtgggtatgtgggagaggtttgtattttaggtgtcctttaaatagcagctttcttaaattgaaggatgtggctgggcgtggtggctcacacctgtaatgccagctacttgggaggctgaggcaggagaatcgcttgaacccaggaggcagaggctatagtgagccaagattgtgccactgtactgtagcctgggcgacaagagtgaaactcagtctcaagccaaaaaaaaaaaaaaaactcatctgtaaaatagggttaataataccttccctgtcaagcctgggtcatgcaagtgacataaagcatgtgaaaaggtcaagttaaggtagtactttgagacatgataataggttggtaatagatcgcttactacagaagtagttagtagagatatcattaacatttgaaaatatcagaaagtatgtgaaattataagctacaaaactgttcctagtcaggtgaatacctattctacagcataatggatatgtgggtgaaatctcgtcggtaacaatgtgaagagatcagcacagttctgtctggtactccctaggcagcagatttcttctctatctgttgaaggtgtttattttatgtttaaaccttcttatgattttactcattcattaaatgtttattgagtgccatctgcaatgtaccctagtaggttgctcattcatttcttctttgctttaaaagtagcatttctgtgagcctttagagcagtttatatgcactggggcaccataactggtatctaagccagagaactaggcacccaaatgattaaattgtgatattctgtctgctttatttttttttctagtttccacgttccttttcctgtttaaggacatgttttttctttgacagtgatttttataaaagcagtttatttccctggaatgaatcttttcagaagcaacaaggaaatttcagtaggaattacatgacaaatatagagaatccattgtcttattttgttactttatggccagatggggtttaacagaaaagtcagatttctttttagtaaggtgctgatacatttctccctttctcttagaattcaaatatattgtgtattcacagagtactgtaccatttttaccacacatggcaggctactgtttctttaatatcgtggcactgggaatattgtgcttatggctttcttaaaatattttaatattagtgtggacaaaaattgctatttctacaaatataccctaaacccgatttcaatctctggtacctatacttcatttctttccacaactctcccccgactctcccttttttatatccataatggatttaccgagggtttaaaattttttctcttaaatataagcttaatcctgctacttatacaatttgaaaatcagaaagggaagaaaagaaagacttcatattccttcccagcagaaataactgcttttaatacctttgtgtgtttccatctgcaggtatattttgaattcaaaggaaaatggatcacacatattaaagcttttgttatgcaaatatttcatattattttaacataaatattgtaattttacctaaatatttccataatggtttcaatcagcatggaaatggttttagagtgcttatattaatattttggttctttatattttcagtggggacacattagtcacttgatacaataccaacccagaagaaacattttcaagtataaattttcaatgtgaatacgttttaaagttgatatctcctggatttgtcaacagtatttgtttaatttatgcttcatttaccattgtgattaacaagctgccaaacttttgaaacattcaaaatcagtgctaatcgagattcatacatctgagtagaaatctggaacctctgaaagggcatcttaatttaaacacttaatttttttctttttgagcaaggataaagtattctttcttacctatacgttattggttgtgatcaaagctttatttatggtctgacatttgataattaagctttctctcttttattgcattttaaaataggattaaaaattttttttgccttacgtaatttttagtgtaccataacttttactggagtgtatatgggaaaatgtacaaattataaatgtacagcttagtgagtttttacaaatttagcacccacatacccatgtaaccactcaaccaaaataaatagattaccagaatcccagaaacaagcatgagttcacgttcagtccactggtttccatccctaaatgggcaacagtggggaaaatatgacacttgtaaccattattctggcgtctaacgtcatatttgtaaagtaacatactaatcacatcttactgtaaagtgaaaaaaacaagggactctgagagaaaaatgctaaggactcattacttaaagtgaaataattaattaaagaccttttcctaagcagtatttgatactaggaattgaatgtctttctattaaggtaacatttttggaaaaagctaatttttaggccaggcgtggtggctcacgcctataatcccagtactttgggaagccgaggtgggtggatcacctgaggtccggccaacgtggcgaaacccagtccctattaaaaatacaaaaattaactaggcatggtggtgcacacctgtagtcccagctacttaggaggctgaggtaggagaatcgtttgaatctgggaggcagaagttgcagtgaactgagattgcgccactgcactctagtctgggtgacagagcaagactctgtctcaaaaaaaaaaaaaaaaaaaaaaaaaaagctgatttttagacatgtctctattagagacaaaattattcatttaattccgggatttgtagtcattttggaactttgctgctacttaattgctaaatgactaatgggaataaagggatgtcttagaatcattaccatcctttggtgcaatcattactagactataatgcccgtttatagttttttttggtgggggacagggtctcgctctgttgcccaggctggagtacagtggcgcgatcatggctcgctgcagcttcagcttcctgggctcaggtgatccacctcagcctcccgagtagttggaaccacaggcatagcatacgccaccgtgtccaactaattttttttttttttttttttttgtgacagagtctcgctctgtcgtccaggctggagtgcagtggcgcaatctcggctcactgcaagctctgcctcccgggttcatgccattctcctgcctcagcctcctgagtagctgggactacaggcacctgccaccatgcccggctaatttttttttgtatttttagtagagacggggtttcactgtgttagccaggatggtctcggtctcctgacctcgtgatccgcccgtctcggcctcccaaagtgctgggattacaggcgtgagccaccgagcctggcctaattttggtattttttatagaggtggagtttcgccctgttgttgaggctggtcttgaactcctgggctcaagcgatcctcttgcctttgtctcccaaagtgctgggattacggtgtgagccactgcgccctgccttttatagtcttaatgttaaaatttagcagcattttacatttcaaaactgaggcctaaaactttcaacctaacctaagtggtatctttcttagttacccttatattctatctggttatccagatgaatgtagagagaacttttagttccccatattcaattttgttttgttggcactttagattatcctgaagtcttttagtttcttgagtcttcgtttgttgtttgaagagggtttaacttggtaaccaggatctttaaattgggcacagaaagatatactggatggctggacaagataatgtatttctttgatgatcattactagatttactaattgctaacagttcatgaaggtttttttgcagtgtctagacaatgtcagcccaagagactgaaattctaaatgaacaaacactgagaaatatttgaagaattcattcagtaattacctatgtaacattcttgctaaaggtgtttaatttaagctgagcttagttatagtagacaatcagacaaatccagtttgtgggactttctacaagacagttggcctgaactctaaaaatttcaaagtggtgaaaacgaaacgaaacaaaaagggcaggaagactgttctagatgaaagaagttgaaagagaaatgacagtcaagtacagtgtcaagcctggattaagaaaacaaaaaaccatagaggacattttggggataactgggaaaatttgaatatggtgtatatattagacggtattataccttttttttgtttttttttttttttgagatggagtttcgctcttgttgcccaggctggaatgcaatagcgtgatctcggctcaccgcaacctctgcctgccgggttcaagcgattctcctgcctcagcctcccgagtagctgggattacaggcatgcaccaccgcactgggctaattttatatttttagtagagacgaggtttctccgtattggtcaggctggtctcgagctcccgacctcaggtgatctgcccacctcggcctcccaaagtgctgggattacaggtgtgagccaccgtgcctggcctatatcattgttaaatgtcttgaatgtgactatatggtattatggttatataggaaaatgatcttatttttaggcaatacctgatgaagtattagtatgttgaaatgtcgtgatttttgcaatttgcttttaaattgttcaaaaaaaaatcatttgtagagaaaaaagcgaaagtggcaaaacatttactatggtgaatctaggtaagagcatatgggtgttcattttatgattctttcactttttaaatagatttcagtttttcaaaatgtaaagttggggacagccaggcatggtggctctcgcctatagtcccagctgcttgggaggctgaagcgggaggattgcttgaggccaggagttccaaggcttcagtgaactatgattgcactactgtgttccagcttgggtgacacagtgagcacccatctctatttaaaaaagaaaaaaaagttagggagaaaaaaagtacaatgaagaaatggcttggctgggcgcagtggctcatgcctgtaatcccagtactttgggaggccaaggcggctggatcacttgagctcaggaattcgagactagcctggcaacatggtgaaaccccgtgtctacaaaaaatataaaaaattagccaggtgtggtggcctgcacctgtggacccagctacttgggaggctgaggtgggaggatcacctgagccaggaggtggaggttgcaggttgcagtgggccaagatagcgccacactccagcctgggtgactgagaccccatctcaaaaaaaaaaaaaaaaaaaaaaaaaggaaatgcctcaaaacagctacagctaggtttaggaaaggctgtcatcatatttgaggattccatagtgtcttaatgggggaaagctgaaaagaagaaaatgagccttaaagaatattatagctgatgtgaagtggaggcagcttgtttagcagaaaaagtagtggtttcagctgcatgatgggggttagaaaaacatacagaagtcagtatggagaaagaaaaggtacttaactaagaagtagagagaagatgggcaaactagaagggccagagaactgaaatacataaaatgaagaaaaagaagagggatagttgaaaactggtggagcagttgacatcaatttcattaatgggacagcaagactattttgatgactgttatttttttcttttcttttttttttttttttctgagacagagtctcgctgtcgcccgggctggaatgcagtggcgcaatctcggctcactgcaacctctgtctcccgggttcaagtgattatcctgcctcagcctcctgagtggctgggattacaggtgtgcgccaccacacccagctaatttttttttgtatttttagtagagaaggggtttcaccatgttggtcaggctggtcttgaactcctgaccttgtgatctgcccaccttggtctcccaaagtgctgggattacaggcgtgagccaccgcgcccggctgtgatgaccatgttttaaaaacccaaaacaaatagacttataaacctattctgaaatcatagaaaatccaaatattacccagacagttgatgtggaaagtggaatagctatgtttttaattttattgaagagattgaagtgaaaaaaggggtggtagtgggataaagtaaatattaacactaatgagtagaggagaaaaaaaggattttctaagtgtatttttcatccctgttaattgcaccactcacccatttagtcactgattcagatgaccagcctgggaatcaggccagactctttcttctccattttactgcatgtccagtcccaccagactaaatgctgtgaacctttggtttgtacatatcctctacttcatcctattctcacaccttttgcttgtgccattgcaggagcctcttgctgagactatgtagtctgtccacgctgtcatcgtgatctgtgaacaatatcaagggtcattcttgtgctcaaaatccttcatgagcacttcctgcctgtgggataaactctttgttgatgggcagtaccctgcatgctaaacctctctaggcttgtgttccatttcttcctcctcatttcacaaccctcatccccaacctactttatttttatttatttatttatttatttatttatttatttatttatttatttatttattgagacggagtctcgctctgtcacccaggctagagtgcagtggcgccaccacggctcactgaaagctccgcctccggattcacgccattctcctgcctcagcctcctgagtagctgggactacagccacgcgccaccacgcccggctaatttttctttttttttttttaatagagatggggtttcaccgtgttagccaagatagtcttgatttcctgagctcatgatctgcccaccacggcctcccaaagtgctgggattacaggcgtgagccaccgcacccggcccatttatttatttttgagacagagtctcactctgtctcccaggctggagtgcagtggcgccatcttggctcactgcaacctccgcctcccaggttcaagtgattctcctgccccagcctcccgagtagctgggattacaggtgcatgccaccacgcccagctagtttttgtatttttagtagtgatggggtttcaccatgttggccaggctggtctcaaacttctgacctcaggtgatctgccctcctcggcctcccaaagtgctgggattacaggcgtgagccactgtgtccggcccccagcctcctttaatactacaggttgagtgttcctaatccaaaatctgacattctccaaaatctgaagctttttgagtgccagatgacaccacaagtggacactttctttcctgacctcatgtgatgggttgtaatcaaaacctggggacataacccaaagttttttcagtgtccccaagggaaaaagaccctcccagcccccttcggttgtgatatatcttttccatgcacagcatgatggtgatgtccaggcaaccacagattgaccacgtaggtggctaagggtagtgacacatttgctttctaattcagtgtacgcaaatttattttgtgcacaaaattattaaaaatatttataaaattatcttcacattctgtgtatatgaaacataaatgaattttgtgtttggacttgggttccattcccaacacatctcattatgtatatgcaaatattcccaaatctgaaacaatctgaaattgaaatgcttctggtcctaagcactttgaataagaagtcatacttgtcgtcctagaatgttttatatctgtgaatgggctctttgcttctgtgcataatggttttttttttttttaacagttttagagataaggcctcactctgttgtctaggctggagtgcagtaatgcgatcaatgctcactgtggcctcaaacaaactcctggcctcaattgatcgtcctgcctcatccctctgagtagctgggactacaggcgtgtgctgccatgtctggctaaatgttttatttttattacttttttgtagtgacagggtcttgctatgttgcccagcctggtctcaaactcctggcctcaagtgttcctcccacctcccagagagctgggattacaggcatgagccactgtgcctggccctgcgtagaatcttgtccctcagcttgaccagctcctgtttgtttttcaagatttagccaaggggacttctgagaagctttttcttctctgctaagaagctgtggagagtaatggtttgagaacatgggcttcagtcagacatacctggattcaaatttctgtttgttttttttttcaaggagatggagtcttgctctgttagccggctgaagaagtgcagtggcaccatcatagctcactgcagcctcaaactcctgggctcaagtgattctcttgcctcattctcatgcctggcactacaagcatgtgctactatgcccagctcaaattcttttagtgatgcatgaccttagataaatcacttacacttgttttacctgcatttctttatgtgtagaagagggataatgaaacttgcagtggcaagcacatagtgagtactccatatatgttatggtaggtgctgctgccgccatcgctatcatcatcatcatcataagaattactgtctcctatgagctcccataaacaatctcattgctttgcaaatcgctttaaatattttcttgtcctttcttcacaataaactcctctctttaagggcaaccactgtatccttaatgctgaatgcagtgcttaacacacgcttaggtgcttagtaaatatttaagtatgtgcaagcataagaagcttattttatggatgacagtgtaagaaagagtacagactctgctgattaccagccgtgtggcctttgagctttgttatttattttccttgccacaggtgtaaaatgggagatagtgcctacctcagaatttaaagattacatctcatattgtatgtaaagtgcttagcataatgcccatagtgggtggttaataaatgttagctattatttaaaaaataaatcaatcttggatcttggcgagatttgacagtagatctattttactttaagtgacatgtgaaatgaagatttaagagtactgtattttatatagtcacgcttacatagttgcttaataattcggagttctgacaaatgcatccttaggcgatttcatcattatgcaaacattgtatagtgtacagttatcccttggtatatgtgagagcttagttccaggacccccacatataccaaaatccctgaatattcaagtccagaagttggccctgtggaacctgagaattcaaaaagttggccctctgtatttgcaggatggggttttgcagcctgtgtttggttgaaaacatttgcatataagtgaaccagtgcagttcaaacccatgttgtttgagttaaccatacttatacaaacctagatgttatatatatctacaaacgtagatgttacacacctaggctgtatggtatatagcctattgctcctaatctacaaacctgtgcagcatgttactctatttaatactgtaggcaactgtaacacaacagtaagtctttgggtatctaaacatatctaaacctagaaaaggtacagtaaaagtacagtattaaagataaaaaatggtccacctgtggagggcacttaacatgaatagggcttgcaggactggaaattgctctgggtgagtcagggagtatgtggtgagtgaatgtgaaggcctagggcattactgtagaacaccgcaggctttacaaacactgcacacttaggctatgctaaatttataaaatatttttcttcaatagtaaattagccttagcttactgtaacttttactttataaacttaaaaatttttaaactttttaactcttgtactcatacttagcttaaaacacaaacacatatagctgtacatattttctttcatatccttattcttataagcttttacgatttcaaacatttcttatttttaaaacttttttgttaaaaatgaacacacaccacatacattagctgaggcctccagagagtcaggatgatcaatgtcactgtcttctacctccacctcctgtcccactggaaggtcttcaggggaattaacaggcatggagcagtcacctcctatgacaacaatgccttctcatggaatacctcctgaaggacctgtctggggctgttttacagttaccttttttttgttgtttttgttttttgaataagtagaaggagtatactctaaagtaatgattaaaagggtggtatagtgaatgtataagccagtaacatatttgttatcgttatatgactggcagtgcagtaggtttgtttacaccggcagtaccacaaatgtgagtagtagtgccttatgccgtgatgttaagacaggtgaaaacatcactaggtgatagaaacttttcagctccattataatcttacaggatctctgtcatatatatatagtcttgtagactgaaatattgctatgtggcacatgactgttttctaactttagtcttagatattgaaaggatttaaggctgggcgcggtggctcacgcctgtaatcccagcactttgggaggccgaggcgggtggatcatgagttcaggagatcgagaccacggtgaaaccccatctctactaaaaatacaaaaaattagccgggcgcggtggtggacacctgtagtcccagctactcgggaggctaaggcaggagaatggcatgaacccgggaggcagagcttgcagtgagccgagattgcgccactgcactccagcctgggcgacagagtgagactccatctcaaaaaaaaaaaaaaaaaaagaaagaaaggacttaaacctaaaatgcttaagaagaaaaatgatgaaattttccttttctatagtatagatagaattttggaagtgatgtattcataaatatttgatgagttcctattacatggagcacatttctggttatgcttagaagggttaaatactacttgaaaagtactcatgcggtgtagcatataatagcctctcaaaaatgtcacagaaatttagaactatatagtgacctatgactaatcccactgcaaaaggagcaggtgactaaattgtagacaatacctggtgtgaaatgtttgttcccttgatctataaattgataatcctttaatgtttaatctgactgtgactagtggcctgaagaggtaagacttttgtgtttttttatgtgtgtgcctacgtatgtttttttcttgtgacctaaggctttgtggaagtttaaaatagagtgattttaatgaatggctggagtaataaagatagttggtgggcttctccatggaagcaagttggttatttttaactactttgcactgctttatggaaaacatatgccactatagaagttattgtttctgttgactgtgactggtggtggttattacttagttggttctaggagggccagtttttagctaatactttgaaagtgagttctgtgactattattacttagttggttctaggagggccagtttttagctaatactttgaaagtgagttctgtgactattattacttagttggttctaggagggccagtttttagctaatactttgaaagtgagttctgtgactatcaaagaccagaggaataatctcaaagaagctgatcagatcatggaactaaagtcacttgttctggtgaggaacagttgaaagggcacataatacttttggtaataatatttaatgtaacttatttagcagtgcgtgttcatgattggcaaggcaggtgagtagattaggaaatgagtctgaaaaagtagggcaggactgctggcttaaaataggagtgaaagcagtgaacagacatagctatttaggcaaatcctagtgtcccatgaggataagactaccacaataatctaaaaataatagcttataggccaataacctttaaggtttatgtttcatactcaccgcaggtcaacccatgtggctgtttctcatttatgcagatctacatcagattttacttgtgtttacctgaaaatacatattgtttatgtagtcaatgtatattgtagtagcatacagaatctgatcttgaaaaggttgcagaatttcttgagtgtactttaggaacttagtttttcaaaatttatttaatttttattttgataattatagattcacaggaggttgtaaataaagaaatgtaaagggaggtcccaaacacctctcccctaactcccttccctctctttgcccgtgtcagtatcccacaccaccacacacagtagtataccaaaaccaggaaattgacattggtacagtccatagagcttgttcagatttcaccagttatacatgcattcctgtctgtgtatgtgtgtttagctttacacaatttcacatataggtagcataactaccagcacaataagggtactcaacagtaccgtaaccacaagatttagttacttcccctgtatagctacaccagtcccccttctccacgggaaactcagttttatagtttggctattgtttttaatcatgtgcaaacctggtttgattaaggtttttgcttctgatttggaagcattgttaaataatttttaatgaaatacaggtaatctgaaagcagctgacacatggtaaaaagctagatttgggaacactgaaagacttcttggatgcataggcttagaatgattctcagctgtgatttatttcctccctccctccctccctccctccctccctcccttcctcccttcctcccttcctccctcccttccttcccctccctccctccctccctccttccctccctccttccttccctccttccccctccatcccttcccctctctcaatattctgtaatattgaaatatttcgttaaaaatatacagcatattacatatatatctgaaattttctcctttcttccttttagtataccttctatttattttggtaccaagaatagagtgctgctgtaacaaacacctaaaagtgtggaagtggctttggaacttctgaaagacccagcccaagtcccatcttcatttatttatttatttatttttaagaattttttttccaaggctggatctcggctcactgcaacctccgcctcctaggttcaagtgattctcctgcctcagcctctggagtagctgggactacaggtgcacaccaccatgcccgactaatttttgtggtttttagtagagatagggagggtttcacgatgttggccaggctgctcttgaactccaggcctcaagcgatccatctgcttcatcctcccaaagttctggaattacaggcatgagccactgcacccagcccaagtctcaactttctcatacacttaattgatttctgtagctatcgttgatttccccctttataatcttccgtacttacagtctgaaccatacaatgtactgcttaactattctgtgtttatatcttgttttatgcgaattctactcaactagagcatatgattcttcaaggtagaataaatgtgttaaacttgtatatttcggccgggcgcagtggcttacgcctgtaatcccagcactttgggaggccaaggcgggcggatcacctgaggtcaggagttcgagatcagcctgggcaacacggtgaaaccccgtctctactaaaaatacaaaattagccaggcgtggtggcacatgcctgtaatcccagctactcaggaggctgaggcaggagaaccgcttgaacctgggaggcagaggatgcagtgagccgagatcgtgccattgcactccagcctgggcaacaagagtaaatctccgtcgcaccaaaaaacaaaaaaaacaaaaaaaacacacaaaaacaacttgtatatttcacacattacccatacaatgtgagcatgtagtaggtaccagataaacatttagttatttaactagaatataattactgctctagtattttttccctagcactttcaaacgttactcaaagaatccttctagctctttgatacaaattttagaacttcactattaacaaatatcagctgggctcggtggctcacgcctgtaatcctagcactttgggaggccgaggcaggcggattgcttgaggtcaggaatttgagatcagcctgaccaacatggtgaaaccttgtctctactaagaatacaaaaattagctggccgtggtggttctcaactgtaatcctagctacttgggaggctgagacaggagaattgcttgaacctgagaggcagaggttgcagtgagctgagatcatgccactgcattccagcctgggcaacagagcgagacaccgtctcaaaaaaaataaaaataaaaataaaaataaataaataaaataaagtaaaataaaaatatatatatatcactactagctaggattttaggaaggctacctatagaaacttagatatatttagttatggaatgttttgtttttcagttggtaatgtacactctttcagtgtttcaaaggaggatactggataattcgatttgaattgtaaatctccccaactggtgttggagaaaccagaggagttgatgattttatacacagtctttcctacctcttattattgagaaaagagtgttaattgtggtcaatgaatttcttcaaagtttgctgcttttaaatcaaattaaggaagtcagcaactataagtagaatgatatgaataaaatgtttcattgttatgaagaagtgttagtagcacgtggcattatgtgtttcacatattgaagttgacaccagaaatatacatttgtaattttttttttttttctgagacagagtctagcactgctgcccaggctggagtatagtggtgcagtcatagctcactgcagcctggaactcctgggcccaagtgatcgttccgcctccacctacacctcccaagtagctggaattacaggcacatgccactgtgcccagaccattttagtgatttgttattttttaaatctctattctctttttaatacagagctgcaaatttcttacttttctttagtgcaatccatgtgtgaaatatgtgttataatttgtaactaacaatatttgaagtcctgaagtttttgaatgatcttgtatgtaagattagagtagattcatggttcccactaataaccacttcattattatcactttgttatgtgtgtgtgtgtgtgtgtgtttaaagagataaacttataggtggtttatctagaattgtgtaaaatactttcattttcatgagagagtatcttgcatgtgagtattatttgtcacatgttatgcctacattgttggttggacttaaactttagtgacctctcagagattattttcattctagttcatgtcatattactttgatatatgtattaagaagaagtacaagagattatttaatgctattgtctgaatgtttgtgaccccccagaatttgtatgttgaaatcctaatccccaatgtaatggtattaggaggtatggtcttggggaggtgaagtttttataaatttctaaaagaaagtataggaaaaatctttgtgactttggggtagactattttcttagataggtcatagaaggcatgaaccataaacgctgacaattggacttttgaaaaattgttcttctaaagatgtttaagaaaatgaagaggcaagccacagaatgggagaaaatatctatactgcattagtggagtttactactaaattaagaaaacattagaagattgtctatatagtataactgattataaaataatgtatttacatatttaaaatattaagatatatactgacatcttaacagtagttgtctttggctggtgagattctaagagttttgtttttgtggtggttattgttttttgttttgtgctcttttaaaaaattgttttgcctcaagtgtatagtatctttgatttataaaaatctttaaataaagataggatagtttgaaagattagcagaatgtttacaatcaatacttgatactacatggataatactttcctattctatttttgtaaattctgtgcttgaaaatttcaaagaattttttgtgtgtgagtgtgtgttttgaggtggagtctcgctatgttgcccaggctggtctcaaactcctgtcctcaagtgattttcccatcttggccccctgtagcattgagattacaagcatgagccaccattcccaggccaaaactttcgaaactttaaaaaatagcatgaaaacctttattttagtccaggtgcaatggctcacatctgtaaacctggcactttgggaggctgaggtgggagaactgcttgaagccaggagtttgagaccagcctgggcaacatgatgacacctgtctctacagaaaatttaaaaattagtcaggtgtcatggtgcatatctgaagtcccagctactctggaagctgaggtgagaggattgcttgaggagttcgaggctaccgtgaggcatgatcaagcagctgcacaccatccagcctgagtgacagagtgagagaccctgtgtctaaaaatgaaaaaagaaaatctttactttatttatttattttttgagatagagtcttgctcagttgcccaggctggagtgcagtggtgtgatctcggctcactgcaacctccacctcccaggttcaagtgattctcctgccttagcctcccgagtagctggaactacaggtgtctaccaccatgcccggctaatttttgtgtttttaatagaaacaggatttcaccatattggccaggctggtcacgaactcctgaccttgttatccgcccaccttggcctcccaaagtgctaggattacaggcgtgagccaccgcacccagctgaaaatctttactttatttacagcactttgtgagccatatttagcaaacatagttccacatatgaagtttgtttttaatgataaggggtttttaaacttgatttttagtataaatacacagtataataaaagtttgtttacattagatatgaagctaattaccacccctaactgctggctggttttctagaattgtagaagcaggtggtgaattttcctgtctgctgatatccaaaacactctgattcctgggtaagttccagcagtattggatgttggtaatattactgttggtcgattaatttatgatagtattatatacatctctaaagtctaattctatgtattttttaagtaaatagtagaataacatggcataacattttaaaaggtatgtggtaaaaagtcttcctattcctaactgtcagccaccagtttcctgccatgggactgttaaatctcaccaccaaagaccaccaagaaaacatctgtagtcaaaaataagttacactgatttagcttgctgcaggaaggaataacatacatcagaagagctgtgggacctctcaaaaggatagagttaggaaagaggacatacaggattttaggagctgttagtcacagagtaatgttaggataaaggtagtagtctgggcagggattggctagaatatgtaatttgagtgagttgctggaacagccagtagttttgcctctaggacacataagtccctgaggatttactgttagatcagtttgtggtactagaacatacgggtatgagtgagctgatattaataaaggtttgaggctgggcacagtggctcacacctttaatcccagtgcattgggagtctaggatgggaggatcgcatgaggccaggagtttgagactagcctgtttaacttagtgagacctcagtctttaaaaaaatttttttaaaattaaaattaactgagtgtggtggcacacacctgtagtcttaggtacttgggaggctgagggggaggatcacttgaactcaagagttggagactgcagtgagctatgatcatgccactgcaccccagcctgggtgacagagggagaccctctctcttaaaaagaaaaaaaataaggtttgagcttagatggcctgtgatgcacagtacattgcggtttggtttggttcagtttatctgttttgcaagtactaagtgcttttctgtgcatctgcaagcaatttgtagtgtaatttcagttttgtttcactttttaatctctgtttctgatcattcgtccgctaaactggaacatttaccatttaggggaggtgatcaatcaagatttcaaactgtcgtttgatgggttgtgaatgtttataaagctttgatggtagacattttggcctctacaggcaccaggccattttgttcttttttttcttttttctttttttttttttgagacggagtcttgctctgttgcccaggctggagtgcggtggcacgatctcggctcactgcaagctccgcctcctgagttcacaccattctcctgcctcagcctcctgagtagctgggactacaggcacccgccaccatgccaggctaatttttgtatttttagtagggacggggtttcaccatgttagccaggatggcctcgatgttctttttcttagatgataatttgttgaatcagctggtgtgacagtggctgcacagcagcatttaagactctaaagatcacacacttggcatctgcaacacactgaaactcagacagttattattaaagtttaaaataatgtcccatatatcccataatctatttggattttcctttgggcaaccaaatatattttttttcctttaatttggatatgggtcattcacctttgcaactgtcccatatttggtttatattttgccaaggataagcatcttgatagtgctaacagtaaggaaaagttatctgttagcagcctaaaatcttacaacagtggagagagaagaaaatgccaagagaataaaggacaaaatcatgcaagtctgtagtcatcagtggcttctggcatctgggaggttgtgttctgattatcttggacataaatagtctattcattttatcttctgcttctggaccataacagttctggaaatcttggctcacccactgtttgtccatggcaatgatgtcggcagtatgcatcattaatttattctctgtagtgtcagtaatgggtgcatgatacaaacatttacaaaagttcttttgataagtcttccacaaggctcaattcctatctttagcttatagccaggaactttagatgaatgtaaggaagaagcggaaaccacctgtggatcatgggactataggctttagttgatttattatattaaccagcattatcagaatggaagggagtggaatcttctattgcagaaagtacataatgaattttatgagtagtcactgattatcctagaagtaagaatatctcacaaacagggaggacattgacagtctctaggactttctttcatttatcctataaagtgtattatgagtttcaccattccaagtttactgaaacctagaaataaaatccttttttagatagctattgtggcagtctttgtactcgaatgtatgttttcttttttttttttttgagacgaagtttctctcttgtttcccaggctggagtgcaatggcatgatctcggctcactgcaacctccgcctcctggattcaagcaattctcctgcctcagccttccaagtagctgggattacaggtgtccaccaccaaaccccgctaattttttgtatttttaagagagatggggtttcaccatgttggtcaggctggtctcgaactcctgacctcaggtgatctgcctacctcggcctcctaatattttctttaagccgaaagatacttaaatgttgaagtatatttattttaaccacattttattatacatgattaaattgggaaggcttaactttccttatgatttgtgaggtttttttttccctttaacccaaatttaataaagcaaagagttctcacaaaagttttaagttaattaaaattcagagtatgccaaacaaagctaataatttttataatcctttaaaaaatttttaataaagtaaaggactaaagctttgttttacctagtggccatttattataaacccaaagatgtagtaggtgtaaaagacatcttaacaatttcttattatttacttattttttagagacagggtctcgctcagctgtctaggctggagtgcagtggctggatcatagctcactgcagcctcaatctcctgggctcaagtgattttcctgcctcagcctcctgagcagctgggactataggtgtgcaccaccacactcaactaatttttgtgtttttttggtagagacagagtttcgccatgttgcgcaggctggtctcgaactcctgagctcaagcaatccacccacctcagcctcccagagtgatgagattctttttataggtgtgagtcatcatacctggactactttttgctttttgactgatgattccaagagccttttcagtgtttagcacatagacgtagatagttgtagtctttacttaagtttgaatgaagtgagttatgcgtgggctgagttcactcaaagcttgcctcagctgggattattgaccatatacccactttactggagaatgagtatgccaagagaccgaggcagaatctgcaaaatcacttctgctgcaatgtatttgttaaagcaggtcactaaggccagttcagattctacgggagagacattagactctccctttttttttttttttttgtcacctaggctggaatgcagtggtgctatcttggctcactgcagcctcgacttcctgggctcaagtgatcctcccacctcagccgcccaagtagctgggactccaggcttgtgacaccacattcggctaatttttgttgtgtttttagtagagacggggtttcaccatgttgcccaggctggactcaaactcctgagctcaagcattctgcctggctcagcctgccaaagtgctaggattacaggcatgagccactgggcctggccttagactctacttcttgataggatagggtcaggtcactgctatgctttaaatatgatccccagaaagcatatgttggctgcctgggtgatgggtatactagaagcccaaactttaccattatgcagtatatccatgtaaaaaaggtacacatataccccttgaatctgaaatttaaaaataaaataagtatgtattagaaaatttatcccaaatgcagtagtgtcgggaggtggggcctaatgagaggtgtttaggtcatgaagccacctctaatgaatgcattaatgttgattataaaagggcttaaggctgcaagttctatctcttgctctctcttatccctctttgcccttccactatgggatgatgcagcaagaagacccatgccagatgcctggcccctcaatcttgaacttcttagcctccagaactatgaatgagtaaatttctattcattataaattatccagtctataatattttgtcatagcaacacaaaacagaccaagacagtgagattacagaagagtatgtagagtgagaaatattattgtagccatttttttttagtttttgctttttttaaaaaattattctttaagttctagggtacatgtgctcaacatgcaggtttgctacataggtatacatgtgccatgttggtttgctgcacccaccaactcatcatttacattaggtatttctcctaatgctctccctcccccagccccccatcctccgaccagccccagtgtgtgatgttccccaccctgtgtccatgtgatctcattgttcaattcccacccaagagtgagaacatgtggtgtttggttttctgtccttgtgatagtttgctgagaatgatggtttccagcttcatccatgtccctgcaaaggacatgaactcatcctttttatggctgcatagtattccatggtctatatgtgccacgttttctttatccagtctatcattgatggacatttgggttggttccaagtctttgctattgtgagcagtgctgcaataaacatacgtgcacatgtgtctttatagtagaatgatttataatcctttgagtatatgcctagtaatgggattgctgggtcaaatggtatttctagttctagatccttgaggaatcaccacactgtcttccacagtggttgaactgatttacacacccaccaacggtgtatttctccacatcctctccagcatctgttgtttcctgactttttaatgatcaccattctaactggtgtgagatggtatcttattgtggttttgatttgcatttctctgatgaccagtgatgatgagcatttttgcatatgtctgttggctgcataaatgtcttcttttgagaagtgtctgttcatatcctttgcccactttctgatggggttgtttttttcttgtaaatttgtttaagttctttgtagattctggatattagccctttgtcagatgggtagattgcaaaaattttttctgtttttgctttttgagatggagtctcactctgttgtccaggctgacgactgtagctgactgcagcctcaacctattgggttccagagatccttctgtgtcagcctcctgagtagctgggagtacaggcagatgccaccacacctggataatttaaaaaaaaaattttgtagagatgggggtctcaccatgctgcccaggctggtttcgaactcttggcttcaagcagtctccccaacttggattcccaaagtgctgggattacaggagtgagtcaccatgcctggctggttgcagccagttttggaaaataaaatgtgctacagacattgtaagggcaaaatatttaacaataactgagatttctaaaaattgcagattggctaaatgttaataaattatgatctaagtaaattatatctacctaggagaaaataaaaaaaaatttatggtattttaaggtatttatttatgtacttatgcattgagatatttgccatcaaaatttttactagtgcgtataagtacctaacacatagtagcaattcaataaaattatttgaatgaattaattgaggatacttttcgatcatagtttttatggtgagagttttcattttgttctgtcttatttttatgtgtattttagttagatgttcgcttagtctattcaagatgtgttttttgtttgtttgtttgttttgagacagagcattgctctgtcgcccaggttggagtttcagtggtgcgatctcagctcactgcaacctccacttcctgggttcaagtgattctcctgcttcagcctcctgaggcaagcacgcgccaccacacccggctaattttttatttttagtagagatagggtttcaccatgttggtcaggctggttttgaactcgaccttatgatccacctgcctccgcctcccaatgttctgggattacaggtgtgagccaccgcccccggcctgttcaagatgttataacaaaatgccttagactgggtaatttgtgaacaacagaaatttatttcttacagtcctagaggctgggaagtccaagagtcagcttgccagcagattgtgtgtctggtgagggcctcttccttataagtggcaccttctatgtgtcctcacgtggcagaagggacaaacaagctcctttggacctcttttgtaatggcacaaatgccattcatgagggcagagtccttacgacctaataatttcccagatattccacgtcttaataccaccatgttggggattaggttttacctatgaatttttggaacattcaaatcatagcagctgttaagaaatgttgaatcagaagtttctagtcattcttttttttgtttttttgaggcagagtcttgctctgtcgcccaggctggagtgcagtggtgcaatctcggctcactgcaacctctgcctcccgggttcaagtgactaccctgtctcagcctcccgagtagctgggattacaggcgcccgctaccacgcccagctaacttttgtatttttggtagaggcaagagtgtcaccatgttggccaggctggtctcaaactcctgacctcaggtgatctgcctaccttggcctcccgaagtgctgtgattacaggcgtgagccactgcacctggccagaagttgctagtcattctaaactggaagcttgacataatattttgaatcaagcattttaaaaatgtctgcttttcataaatagtttatttttacatatttatccctttcatttaggaaagaagattcatgagttttttttttaatcagctggcaaattagagaaaatatttatacagcttctaataggcatctcaaattattttgaaacattgggaatatatcttttgtaatgttttgcttgtaataattgaatagattttctcatttggtaataacttggaaaatacaaagtggcccatttaaaatggactctgatttaaaggtactgttggaggcattggtgacgggccatttttccttttaaatagagaaagtatgacaatctattttcaagaaactgccatagcaatatttttagtctcatatgctcgcacagaattttgtcactccccaccagtaggtggaatctatttccactcttcttgaacctgggcaggcttgtgactgttcaaccaattgaatatggtggaaataatgtgatgggatttctgaggccatgatataaataggatacaactgatccagcaatcgcactactgagtatctacccaaaggaaaataaatcaacatgtttattgcagtactattcacaacagcaaagatacagaatcagcgttgagtatctattagtggatgaatggataaagaaaatatggtatatatacacaatggaatattgttcaaccataaaaaaacaaaacaaaataatgtcacttacagcaacatggatggaactgaaggtcattatcttaagttaaataagctaggcacaaaaagacaaatatcatatattctcacttatatgtgggagctaaaaatttgaacacatggaggtagagaatggaaaatagataagagagactgggaagggtgagtgggggaaaggggaaggatgaagagaagtgagttaaagggtacaaacatacattaagataggagtagattcaatgtttgatagcagagcaggatgactatacctaacaaaaatgtattgtacctggtgatgaacatcctgaagaccctggcttaatactatgcataatatacatgtaacataattcctcatgtaatctgtaaatttgcacaaataaaaagagggaaaaaaaaaagctacagcttcttcctggctctctctttgtcttgggatgcttgttgttggaactaagtcatacgaagaggccacatgtgggtattctcttcaaaaacctgagctaagctgcagccaacagccagtattaaccacagtatgagtgagaaagctttcaggtaattccagccccaggttgtcgagtatcctgctgaggccccagaagttgcggagcagagacaagccagccccactgtgccctgtctgaatttatggtccacagaacctgtgatagataataagtgattattgccttaagccactaagttttggggtaatttgttacatggcagtagataattcatataatttctagaaacttatagggaaataaagatttgctcaaagacatatatatatatatatatgtgatatataaatgatccatgtatatatatatgatatgggtgatatatataaaataaatatgggtgatatatatatatacacacacacacacacacacacacacatacatatatatatgttctctgctgtatcatttatttatgttttcttttttttagaggcagaatctcactctgtcacccaggctagagtacagtggctcagtcataggtcactgcagccttgaactcctgggctcaagcgttcctcctgccatagcctcccaaagcactgggattataggtgtgagccacgatgcctggccctgcagtataatttacaattttttgaaatagtctagctatccaacaataagaaaatgtttaaataaattatcataagcacactattttcctaagtaaaatttctacattttctatattcaaaaacaaagtttaaagaattggtatatagtcaattatgtcataatgataaacctaattgaattatatatttacataaataaagatcattaagaacaaaaaaggctttacatctgataaaggacatgtacccagaacatacaagaactttcgtcagtcaataagaaaagatactaaatgttttaaatggacaaaagaattgaacaagcacatccccaaagaagatattcaaatggcccttaagcaagtagaaaggtcctcaacatcactactcatcagggaaatgcaaagtagagaacaaagagataccggtagacgttcactgtactggaataaaatttagcagatgagcaatattgagtgttgacaaggatatgaagtaactggaacccttacaccttgatggtgtgagggtaaatggtatcactttgtgaactgttgggtaaaaccaatgttgaccccataaactttcagtcccattcttgggtatatacctaagagaaaagagtgcttatgtccaccaaagcacacatagaattatattcatagcaactgtattcataatggctcaaattggaaagctgctctagtcatacattgtctgcccttacctttattaacgcagtagtgcttagcatgtagctacctgtgtttagtttaatatgtattattaatgaaaatttatttaggggatttcacccccaattttttaactttatggtttcaaatttcttaaaacctttctctttacatcagtttggttttggaagactaaaagaaagagcttgttgcacagatggcccaaagcacaaattattaaaatgctaacttttatctacatccagctccaaatattcccttactccttgatcattcttttttttttttttttttgagactgagtctgtgtcacctaggctggagtgatagatgtatatatggtcccctattctaaggtaatacagtcatgcatccgagaaatgtgtcatgagatgactttgtcattgtgagaacaccatggaatgtacttacagaaacctggatggtgtaactgctatacacctagatggtgtaactactactatgcatagtctatatgatatagcctattacttctaggccacaaacctgtacagcaggttactgtactggatactgtaggcagttataacacagtgctaagtatttgagtatctgaacatatctaaacatagagaaggtacaataaaaacacagtataaaaggcaaaaactggtacacctgtatagggcacttaaccatgaatggggcttacaggactggaagttgctctgggtgagtcggaggtgaatgatgagtgaatgtgagggcctaggacattattgtacactactggagactttataaactttataaacactgaacacttaggctacactaaatttaaaacaaatttttcttggctgggcatggtggctcactcctgtaatcccagcactttgggatgctgaggtcggcagatcacttgagtccaggagttcaagaccagtctggggagcgtggcaaaaccccatctctacaaaaaatacaaaaattagccaggcatggtggcgcacacctgtagtcccagctgaggactgggaggctgaggtgagaggatcatttgagccaggaggttgaaggtgcagtgagccatggtagtgccattgcactcccatctgggcaataaagcgagatcctatctcaaaaacaaattttttttctttaataatatattaaacttagcttactgttaagtttttactttataaatgtttcagtttttaaaaacttttggacttttttgtaataacacctagcttaaaagacaagtacattgtatagctatagaaaataatttttctttatatctttataggctttttctatttaaaaagtttaaatttttttttaacttttagaatattttggtaaaaatgaacacacacacacacacacacacacacacacacacacacacacactgagcctaggtctacacagggtcaggatcatgaatatccctggcttgcccccctacatctttatccactggcacaccttcaggagcagtaacaggcatggagctgttatctcctaggataacaataccttcttctggaagtcctcctgaaggacctgcctgaggctcttgaggagatgtcactcttttcagaaatttgcccatggtgttttgcttggtttatttctatttttcattgtagatttgtttgtaagcagttaatgcagcatgaacattcctgtgtattaatgaaaacctttctgtttttgggggtccatgttttcacacttcctaaggagtttgttgaggtgtgcaaaagcttctcccaaacccttcactgtgagttttgttgggggttctttttctttctccagcaaacttccttctctcttgctgcttcttcagctttgcattcctattccagttcccactcattagtcaattcctgcgatgttattgtggctataacgttactagatgacaggagtttttcagctccatttaactacagtccattgttgaccaaaacatcattttgtggcacacaactgtatttagctattttagtggttgggtagctgctatcgttttttcagtgaaatttgagtagttaaaatgagtcaagtagtagctgaaagcatgacgaaacttataataggactttctttacttgtaaatgatacaatatggtatggctagattaagtcttttaaaaatactcatagatttcaacttggttccataaagctggaagtggaaacattggacatatatcagaaattcaattgaacgcctccttttaaatttatggtttacagacttgtggctcttagatcccaggggatctaaagtagactgtgttataaagtaggcacataacaagacaacagccaatttaaaaatattaaatgaacttgctaattctccatgatattatatatataaactttgtacctaatgtaaactgaaggtagttattagcatttccaggttagaaaacataactggacttcccttatccactttttttttttttgaaacggagtcttgctctgtcgcccaggctgaagtgcagtgtcacaatctcggctcactgcaacctccatctcccagattcaagcaattcttctgcctcagcctcccaggtagctgggattacaggtgtgtgccatcacacccggctaatttttgtatttttagtaaagacagggtttcaccatgttggccaggctggttttgaactcccgacctcaggtgatccacctaccttggcctcccaaggtgctgggattacaagcgtgagccacaccacacccggccccttatccattcttttatgctctgttactacagcaaattattctcagacatagctccatcttggtagtagtgttcttgttattatcagtaacaaagtacattaagctactgccttttgttttattctgttttgttttgttttattttgagacagtgtcttgctctgttgcccaggctggagttcagtggcgcgatctcagctcactgcaacctctgcctcccacgttcaagcgattcttctgcctcagcttcccgagtagctgggattatgggcacttgtcactacacctggctaatttttgtatttttagtagaggtggagttttgccatgttgcccaggctggtcttgaactcctgacctcaagtgatctgcctgcctcagcctcccaaagtgctgggattacaggcgtgagccatggtgcccggccgagacttctaaaacataggtgtcattaggacagttctataggagaaataaatgccattttagtattatgactacttttctttcattttctttaaccatagtttcatttttaacacctgttctatagatagaaaaacaaagatactcatgtcatctagtgtcttgtctcatttataacttgttccctgaatcagcttcaagtctttcatgtttatgtgtaaaacatagggctgggcgcagtggctcactcctgtaatcccagcactttgggaggccgaggcaggtggatcacctgaggtcaggagttcgagagcaggctggccaacatggtgaaaccctgtgtctactaaaaatgcaaaaattagccaggtgtggtggcatgcttctgtaatcccagctactcagaaggctgagacagaagaatcgcttgaactcaggaggcggaggttgcagtgagctgagatcgtgtcactgcattccagcctgggttgacagagcaagcctccatctcaaaaaaacaaacaacaaaaaccattataatttatgcacacacaaatatttaaaatgactgtcacctttttatacttagaattgatcatttatgatacatagtatcttagaattttttccccacgtactggtgctgtggatgtgaaatcatggtgatttattaggtttaatttgtcatgtaaaagaattgtgttctgtttgttctctatacatttaaatattttaaattattattattatttttttgtagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacaggtataaaaagtctttgcatgatacttttttacagtatagatttgcatgagcagttttgagaaataattacaaataaccagctaaaaagtggtgtggtaatttttctagaaattatgagacagtcaggattggttaggatatttgttgttaattgaagaaatacaattttaagtgtctcatatttccagtagaactatttagtatgagtagattgactacagttttacagcagtcctgtcaaaagctggagtgatttaagttagaagttaaactgtgatcccttttggtgtaatgcccttcgtcttctaaggtataatttctcacatcactttatgctttttttcctagtatgtggtgatattcatggacaattctttgacctaatgaagttatttgaagttggaggatcacctagtaacacacgctacctctttctgggtgactatgtggacagaggctatttcagtatagaggtaaaaattaaactggatatgttgggactattatattgtctttcaaaaaagatgatttccattcttcagtagaagaaattaaaatgagaactctggcagaatttataaactttgttactttcaaaattaaagtagtagaaatgttttaattgatagaacagttattccttttttaaaaccagtcgaaaatctgacaaataggctatatattaatattaacccaattttacaaatagttaaatgttcaccaacttttcctcttgaagatagtatacaggattgtataaaaatgacataaattgctgttcaccctaaatggggtttagattagctgaccttaattataagaccataagctgctgagctacaattaacacttagattaactgccagtgctaaataaacactaagctttttgtaggaataatgtctggtactggtacacatagtaagcacttaataaatgttcactgaaggggaaaaatgagttgtagttaattaaaacttatactttccttttatatattttgaaaatggaaagataggaacatgtttagaattaaatagaagctttaatgtgtaaaagataaaactactttagaactttatgcaaggacttgagtacagtggaaccacagcacattcctagttaatgttcattgattcaactctacatgctggcaaataaaagagaaaaaaacttttgaaatagcgtgggtaataggatttgtaatgtgaccaagaataagcatgagctgagaaattgagtctgctttctgtcttgctgtctatagtcctgcctgccctcattgtgtgagaatctcactgtactaagtgtgtttctggtggttaaaggtttattgtcttgcagcctcactcctaaatgcaagtcagctctctcacctgatgcccaagcaaaggagcagcagttgctctattgctgtagaaaaaataagcaaaaaaatggatttttagttttctgttagataggcaatctaaattcatgaatcagaaaagttcaatgttggccaggcacggtggctcacgcctgtaatcccagcactttgggaggccgaggcaggcagattacgaagtcaggagatcaagaccatccttggtaacatggtgaaacgccgtctctactaaaaatacaaaaaattagccgggtgtgtaggcaggcacctgtagtcccagctacttgggaggctgaggcaggagaatggcgtgaacctgggagacggagcttgcagtgagctgagatcacgcctctgcactccagcctgggcgacagagcgagactctgtctcaaaaaaaaaaaaaaaaaagttcaatgttagttgccagtgcacaaaattcatttagtgtcaaatgtgaggacaaaagttaaaggtataaactgacaaaatagtaaagcccatttttccttctgctccgtaaatgtccaaggtctctaaataggtactgggaataggcggagattatccttgcagactgtatcattgaggagcttccctgttgccactcatatcatgcatgtttcagtagacataagtcaaatgtatggatgtggggctgcgcgcaatggctcatgcctgtaatcccagcactttgggaggccgaggtgggtggatcacctgaggtcaggagttcgagaccagcctggccaacatggtgaaaccccatctctactaaaaatacgaaagtttaccaggcatggtggtgggcgcctgtaatcccagctacttgagaggctgaggcaggataatcacttgaacctgggaggcagaggttgcagtgggctattgtgccgctacactccagcctgggtgacagagcaagactctgtctcaaaaaaaaaaaagaaagaaagaaagaaagtatggatgttagaaagacacattgagttcagtttatttctttgtgtttttgctagcatgagaaggtttcagacggtaaagattagaagaatacaaaaattactgaatttctaattaggcattttattttattttatttttttagagatggggtcctgccatgttgcctaggctggagtgcagtggctatacacaggtgcgatcatttcgtacctcagcctccaactcctggattcaagccatcctcctgcctcagcttcctgagtatatggaactatagatgcacaccactgtgcctggctagtcattgtatttaataaaacaacttttaaaatatttatttatttatttatttatttattttttgagacagagtttcgcttttgttgcccaggctagagtgcaatggcacgatctcggcccaccgcaacgtccgcctcccaggttcaaatgattcttctgcctcagcctcccaagtagttgggattacaggcacctgccaccacgtctggctaattttttgtatttttagtagagacggggtttcaccatcttggccaggctggtcttgaactgctgacctcgtggtccacccaccttggcctcccaaagtgctaggattacaggtgtgagccactgcgcctggcaataaaacaacttttttttttgagatggagtcttgctctgttgccctggctggagtgcagtggcacgatcttggctcagtgcaacctatgcctcctgggttttaagcagttctctgcctctgcctcctgagtagctgggattacaggtgcttgccaccacacccggctaatttctgtatttttagtagagatggggtttcaccatcttggccaggctggtcttggactcctgaactcgttatccacccaccttggccttccaaagtgttgggattacaggcatgagccaccgcgcccagcctaaaacaactttttagtgataaattattatgccaaattatcttctgattaactcgtataacttaaaatagctttaaaatagttttaattcattaatacattcaataaagcacatagaaaatatcaacaatgattttgtgcacagacatcatgttcagaatattttgtgttatgcatttttttcctcactcatcaataaagtttcttgagtgccaactttatgggcaggctgtgagaataaaataaagaataaaatttatgctctgtaggagcttccagtctaatagaaaagatgcacttacgaatagacttttgttataatataaaatgtgcttcttgaattaacagcgtttttcatattaggacttagcacagtgcctaacacatagtaggcacatagttaatatttgttgaatgaatgaatgttaataaatcatagtttgtatttagctttattctgttaattagatgtttgctaacttaaagggttttttctgcaataacttcagagataaatgaatcaaaactttaaggtgacaatgacattttataccagtgttaaaaccaaagtatgagatctatcgagtattcattggaagtcacttatttataaaccactaagattataaacctctataggctatagcttactctaacatgttgcaagtatacacttgaaaaataattttttaataaatattcttgatagccatgagtgtgatgtttttgtttaatagatgaaaataaggtcatggaattcttattaaaattttttgttataaataatttatttttaatagaaaagttgggaaatgcagaatctagaaaacaaaaactttctacaaatcagagataatcactgttaatgttttattatactttcttgcagccttttttcttcttttacatttgtatatattttgttttcaagaaaattgagagcattttgtacgctccttttctgatcttctttttccactcaagattgtatggaaagcatttttctgtattgttttctccagaagtgtagtgtcaaagtcaaataaaatagagacaaatctctgaaattaaaacattttatctgagaagaaaaaagaccagcctggcgaacatggtgaaacctcgtctgtactaaaaatacaaaaattagccaggtgtggtggtgggcgcctgtaatctcagctacttgggaggctgaggcgggagaatggcttgagcctgggaggtggaggttgcagtgagcccagatcgccccactgcactccagcctgggtgacttagcaagactctgtctcaaaaaaaaaaaaaaaaagaaaagaaaagaaaaaatgcaatttggggcatacacacagactgagcgggctttggtatgtctgaagaaaagagaaggttaggttttatgagaaagaaaaatgttatgtattgctgtttgagaaagttcattgacactagtaaggttctggagggctgacaagttttacttaatctcatgtaatcaatttatattctgcttgatctccgttaatagtttcatgagtccgtcagtttctttattagagttgtggaaatttttatttagcctattgcacttaatgttatcagcaacctatatttaagagtacttgttgaagtcttttccatgaatctgattgtgcatgtttttagagacaaaacagtaactgtggatgacaaaagcttagaacagccatggttaaaaatctgatgaaagtttacgattgataaggaattttgttatttctattatagatagcattttaggatacaataatcagaattaagactgagttatgagttatacaatttttatgagttatacaatttttgaaacatttatgttaacaacatacccctaaatgcaactaaaataagatctagtatcacttaccatttaacagtttcttatataatttactaaatgagcctgatcatttcatatctctgtaagatgagagatatagatcttttgaggctttccaggggctgaactggaaaatcccaaagttaatttaatttaattttatttttttgagacggagtctcgctctgtcacccaggctggagtgcagtggtgcaatctcagctcactgcatcctccgcctcccaggttcaagtgattctcctgcctcagcctcccaagtagctgggattacagccccccaccaccatgctcagttaatatttgtgtttttaatagagatggagtttcaccatattggccaggctggtctccaactcctgatctcaggtgatccacctgcctcagcctcccaaagtgccaggattacaggtgtgagccactgcagccagccccaaagttaattttaggtcaaaagtacttaattgaggctggtcacagtggcttaagcctgtaatcccactgctttgggaggcctagatgggaggctaacatgtgtccaggagttcaagaccagcctgagcaagaccttgtttctataaaaataaaaaacaaaaaaagacttaattgaggatttgattttggggacgtttgtcaaagatgtcaaaaggctcagaacatctgatcaaaacagaatcacacaggtcactataaaataatggtcatttggctgtgcgcagtggctcatgcctgtaatcccacacttggggaggccgaggcaggtggatcacctgaggtcaggtgtttgagtccagcttggccaacatggtgaaaccccgtctgtactaaaaatacaaaaagttagccgggcgtggtggtgggtgcctgtaattccagctacttgggaggctgaggcaggagaatcacttgaacctgggaggcagaggttgcagtgagccaagatcgcgccactgcactgcagcctgggcaacaagagcgaaactctgtctcaagaaaaataaataataataataataataataataatgataatattcattcagccagtgataaaagatttccaaagtaatacagaaagttacatggatgtaaaaacgttagtttccttaaagtttagttttcctaagttataagatacctaatgagggcaacacagaaattatcttgatgaaatgtggaagttttgtgttctttttttttttttaatgttttaaattctggtatacatgtacagaacatgcaggtttgttacataggtatacatgtgccatggtggtttgctgcatccatcaacctgtcatctacattaggtacttctcctaatgctatccctcccctagccccccacctaccaataggccccagtgtatgatgttcccctccctgtgttctcattgttcaactcccacttatgagtgagaacatgtggtgtttggttttctgttcctgtgttagtttgttgagagtgatggtttccagcttcatccatgtccctgcaaagacatgaactcatccttttttttggctccatagtattccatggtgtatatgtgccacattttctctatccagtctatcactgatggacatttgggttggttccaagtctttactattgtgaatagtgctgcagtagacatacgtgtgcatgtgtctttatagtagaatgatttataatcctttgagtatatacgcgataatgggattgctgggtcagatggtatttctggttctaatccttgaggaatcaccccactgtcttccacagtggttgaactaatttacactcccaccaacagtgtaaaagcattcctatttctccacatcctctccagcatctgttgtttcctgactttttaatgatcgccattctaactggcatgagagggtatctcattgtggttttgatttgcatttctctaatgaccagtgatgatgagctttttttcatatatttgttggccgcataaatgtcttcttttgagaagtgtctgttcatatcctttgcccactttttgatggggttgtttgtttttttcttgtaaatttgtttaagttcattatagattctggatattagccctttgtcagatggatagattgcaaaaattttctcccattctgtaggttacctgttcactctgatgataggttcttttgcagtgcagaagctctttagcttaattagattccatttgtcaatattggcttttgttgccattgcttttggtgttttagtcttgaagtctttgcccatgcctatgtcctgaatgaagcatataaaagttttgttttttaaacaggctaccaaaaaggtgaagaaaaaccttctgtagtatgattgtttcttcttatgtgatgttcacttacataacctggaaatcaaaccggatgaaaagagtacttgaattaatcagacagaggaagaatgtgcccaagattatgaatgtttcaattcagctacgtcaagaaaagccaagatacagtagaggaaaacatagcttttttaggcttttaagataaacctcttagtgtcagatcataacagtcgagttagaataggagaaaaaaagttataggagcagatgaaaaagttggagagagtcaccttctagccaagcaaaaagatacgctttttcaagtggagaaagaacagaagggaataatatatgacttgcaatcatgtacagtgaaggacagcagaatttgaacttctgaggtatacatttgagaagtttcaaaaagaaacagatttcagaattaagtatcaaaacctcttgcagttttactaagagaatgtcaatactttaagaaaagccctgttctacaataggagaccaaattttatagttttgtattagtgtctttttactatcaaagctcaatctttgggaagaccacatgtcattttatttttttatttttcaatttttatttatttatttattttgacacggagtctcgctgtgttgcccaggctggagtgcagtggcgcaatctcgactcactgcaggctccgcctccagggttcacgccattctcctgcctcagcctcctgagtagctgggactacaggcatgtgccgctacgcccggctaattttttgtatttttagtagagactgtgtttcacagtgttagccaggatggtcacgatctcctgaccttgtgatctgcctgcctgggcctcccaaagtgctgggattataggtgtgagccactgcgcccagtcccatatgtcattttattttaattatagccagcttgatcacatacaaaattccatttataaattccgttttcacaaaccctattacaatttcactcagaccattaatgacatgcttggactttctgctttgtcctgtatttcctttcttaaataaccattttattttaggatgaaaatttgccacataagattctttgtcatacaaaattattctatttctcaataaaggacacattttaatgcctatcttgtaattaaaaaaaatttttttaagagacagagtcttgctctgtcacccagactggagtgcagtggtgcaatcatagctcactataaccctgaactcctgggctcaagcagtcctcctgcctcagccaccccaattagctaggactacaggtgtgtgctaccacacttggctaatttttttttttttaatttttttagagttgggtctcactgtgttgttcaggctggccttgaacttctggcctcaggataccctccaacctcagcctcccaaagtgctaggattacaggcatgtgctaccacagccagcttgtatcaacaattttaaaaacaattaatttatcaaagatttacttaagtcacaagaactgaaaaaacatttgggttaattactacatattttatatgagcacttgtttacttaaactaatcagaataaatttttttagggatttctggctgactatatgagattttattatgtagacacagcatacaacatagtatatatatataatataagcatatctacacagatatacatacttataaataaattcttatggcttttgttttagagttttggtcatgaaatagtaaaacactcaccaatttataaaaaacagtaggatccagattatctttctgacaaaatggaataaggccaaacttaatgttcttttttaaaacaggcaatattataagggttgtgaactaaattttgagtaaagtagtttgagtcagttaccaataaactggattcgacacagaatagttaattgtggaaatatgactgaattatcttctaacaaggtctgttcagtattttattggtctcaattctttatccttgaagataaaagtgttgccattccttttactgtgggcaggctatctttacatgggaatttcatttttgcaaaggaaagagcatgaaggtcaaaatgattttctttaatatctgctggttttaagtgttttacttaaatggtcagtatgccagaatagttgaagagttttgaagaaagagtttagaaaaagataagaggaggcagagcgggaggggaaagctctagagaggaaagtgattcagctagctttgaggcagtgttttgtagtgagtcattctttgagtcctgaatccttttttttagcctcaaaatatcaatgagatacgcatatcttatttggagtatattattttctaactgtggtcttttagtttaaggaacaacagactgtttgaatgatccttacgatgtttgaacatgttaccggctggaatcccagaaaatatcttggcatgcctttgaattttgagagcccattttattgtgggtgctctggtttaatcccaaatacacaaaaaccaattaaatataagcactgaatttgcaaaggccaaataaacgcaagcacagatgggaaaataaagtacccacttaccaagaaggacgataagaagccttctccaactgaaagaaaaaagagagatcccaaggcctcaacccaaagggaaaaatcccttccctgagaccccacagccagggtctacaaggaggaaaagagtcttccttaataggagatccctcagccagatcagacgggaaggggaaagacaccatcccatccaaatcccagataaaacagaactcaaccaaaatcgggagttcagtccaagaatgactcactaagggaaaaagaggcaacttgcagaagccgttagaggagggggtgactttcagaggtccccagtgtggctaccttgtactatagttccaatggctgctgatcttctctgagatgagtcagccttagactcatacttgaccaagtatgtcaaagtcaaatgaaacacagagatgaatctctgaaattaagatgttttatttgtgaagaaagaattgcaatttagagcatgcatgcagacagaatggtatgtccgaagaacaaagagaaggttagaggttttatgaaaaagcgaaatgttatgtgttgctctttgagaaagttcattggcactagtaaggttctggagagcttgccagttttgattggtgagtgatggcagtgggtaaaattagccttagaatttcagcagatcatttcagtagccattagataaaactggtttccagtaatagcaggcagtttcggcagacatgcttgcagagaattacatttttgggtcaatgttatatgtcctgagtgcttcccccccgccctcttgactctgttttagttgggtatgacaggaataacccagttcatatgatcaactttcacagtagttaatgatataaataccttaatttatttcaccattcctctactgttggaaaaataggtttatagcaggtcatgctattgcatacattttccctctgtcttccttacaaacaatatctctattttattcagatagatgggattggggttgcagggagaagctttgatctcagggaaggaaggcccttatcccagccccagggaatgaattctgggtggtctgaactactcaagccaatcaatttcctgtcactaatgattggtctaggggtaaacactggattttcttttaaccagtaatatataaagggaactctgctgggtttttgtttgtttgtttgcttttggaaacactctttcttgatgaaaagactattgcaaggttgaagcttttggacccccattctaccatttcacttcatatgtggatgtgtgtactgtagcagccatgctgtgactatgaggaggtgacatgactaaggaggaaaagcagacctgtgaatcgctgatcacagaggtacagagggcttggtttcttggtgaagatgttgaactagtacaccaaacctggacatctcatctccagacttgatgtgttttttgttttgtttttttttttttttgggacggagtctcactctgttgcccaggctggagtacagtggcaccatctcggctcactgcagcctctgcctcccaggtttaagtgatcctcctgcctcaccctcccgagtagctgggattacaggcacccaccaccacgcctggctaatttttgtatttttagtagagatggggtttcaccatgttggccaggctagtctcaaactcctgacctcaggagatctgcctgcctcagccacccaaagtgctgggattacaggcatgagccaccgcgcccagcccagactttgtgttttatgaggtatttaaatatcttacacaacagcaaattggatttgatatcacttgtatttaaatggtacaaagttgtcttccaattatttccactctgcacattgctaaagttaacatctttttgaatatatctgtgatggcatttcagatacttagatcagattctcacacatgaagtaactgatcaaagagtagaacatttttaagacttctgccgctgataaaacaaaatagtaaagttttatttatctttgagacttttggtgttccctcttcatttgtacctattacaaaatgctggctgggcgccctggctcacaccggtaatcctagcactttgggaggccaaggagggtgggtcacctgaggtcaggagttcgagaccagcctggatgacatggtaaaaccctgtctctactaaaaatacaacaaattaaccaggcgtggtggcgtgtgcttgtagtcccagccactcaggaggctgaggcaggagaattgtgtgaaccctggtggcagaggttgcagtgagcctagattatgccactgcattctggcctaggtgactgagtgagactctgtctaaagagaaaaaaaaaataaaaacaaagtgcttcctcttcctctgtgagagaagaagctaaattttagtttctttaattgattttgtgagaaaagaaaagattaaagggaacattttcagcaaagatatactgtattaaaagcacagaagctgccaaagagaaaaatgttatcagatgagcaggtgatataaatgttattagatgaccaattgatgaacaggtattgacacatagaaatgattctggaggcagagtaaaaattctgttcacacagaagtaaaaagtaattgagtggttgaacagatctcttgataatcatgaccttgtaattgaattatacaagacaattgtacagttgcatcctgatgtataaaataaggaaataaaacttgaaattagaggccaagaagcacatcaccaaatgacattatactatgggtggattgtgcctttatatatctcgttacctcaaaaaggtgagttagaaggcacaaatgtatacccagataaatcaaaagatatattgtgttcttggttgggaaaggtaggtatagaaaagagaagtgcattctaaatttgtatattgatttaatataatttttccttggaatattttgtgaaaattgttatcttggtaatgaaatttaacccctcaaaagaataaagccacacaaggttatttatatgtgtctacatgtttaagctttatgattattttgcaatgcctgtttcaaaatgtgtatatgctttaatgcaacaattccatttttcagaacctatgctttagatgcactcataattacgtacaatgatgtttgaattgtttgtcacaatgattgaaagtttcttttggcatttgataaacaggcttcagggatacaaaataccctgcaatgtgtaggagacacctaaacaacaaagaatgaatgattctcagattgtcaacagtgcctgtgttagattctggggatctaacagggagatgcacaagcaaagtcctttactgtattttctagtgagagggacagcatcatgtatttgtttaccatccatgagaaccaaatcagaggaaggagctaaagcgggacaggagcagctaacttagatggagtgatcagggcaggttcttttgaagaggcaattgttgaacagaatgacctgtgggaacaagctgtgcatagatcaggggaactacattccaggcagaggcacaaccagtgtaaaagcttacaggcagaagcaagtctagggcagtccatgtatagtagtgaggctatcgaggctagacagaataatgagtaagggagagatggaagaggtgcagagagtggggcagatagatgatgtcaggcctagtaaaccatgtcagtgcatttgggttttattctgaatgtgctaggaagttattggaggaattttttttttttgagcaggggagtgacgtattcacatttatgttttaaaacaattactttggctgttagaaggtcagttgacttttggagcccaaaagcaggtgcagggagaccagtgaggatttaatctagtaatataggtaagagatgtcagtaattagattaggcatactgagaaacatttggattcaggatttcaaagtctttcctttttgaggaggtgggaaagtctcagttgaattgatcgagctcctcaggtcatggcacatttctcatcagtctttgcaaagtccctcttttttgttttattctttttgtgcttatctgtgatctctgagttccttactccctctccccagtatacacatgcttctactgtatttaatatatgattcagaatacatctaatgtatatatgaatgaatgattctcagattgtcaacagtgcctgtgttagattctagggatctaacatggagatgcacaagcaaagtcctttactgtattttctagtgagaggtacagcatatatatatataacaaatatatattatatataatagtgtatataatatataatatataataagtatatattacatataatatacaataagtatatattatatataagtatatattatatataagtatatattatatattatatataagtatatattatatattatatatataataagtatatattatatataagtatatattttatattatatatatagtaagtatatattatatacatacataacaaataaatatatatatattcaaataatttgagatggagtcttgctctgtttcccaggctggagtgcaatggcacgatctcagctcactgcaacctctgcctcccaggttcaagcaattctcctgcctcagcctctccagtaactgggattagaggcgcatgctaccacgcccagcaatttttttttgtatttttagtagagacgaggtttcaccatgttagccagggtggtctggatctcctgacctcgtgatctacccaccttggcctcccaaagtgctgggattataggcgtgagctgccgtgctgagccaatacatctaatatattaattttttaatgtatagagcttttacagataaaatattttaattttacataaatgatatggtgctgtccagtggtcttgaaatgttaacatacaccattattacctggaaagcttgtgcaaacagaggttgcaggaccctgaccctgtttctgactcatcaggcgtggggtggaacctggcaatctgtattctgtcgggttcccaggtgatgctgtttaccacactttgagatgaatgtgaccatactttgagaaccactgttgtagtgctatttatactgttgacttttttcacttaccactttttttatatttatatatattttattatactttaagttctagtgtacatgtgcacaacgtgcaggtttgttacatatgtatacatgtgccatgttggtgtgctgcacccattaactcgtcatttacattaggtatatctcctaatgctatgcctcccccctccccccaccccacaacaggccccagagtgtgatgttccccttcctgtgtccaagtgttctcattgttcaattcccacctatgagtgagaacatgcggtggttggtttttttgtccttgcgatagtttgctgagaatgatggtttccagcttcatccatgtccctacaaaggacatgaactcattattttttatggctatgtagtattccatggtgtatatgtgccacattttcttaatccagtctatcattgatggacatttggattggttccaagtctttgctattgcgaatagtgccgcaataaacatatgtgtgcatgtgtctttatagcagcatgacttataatcctttgggtatatatccagtaatgggataagatatatccaggttactactatacgtgcctctagttgattgctttctgcctgctgtatagaatttcacagtatttatgtatgacactttagttttctcttttgcttggtggacacctagtttacctccagtttctttctaacatgaacactgctatgatgaacaccctcatataaatctaccatgatttaatgtctctaggttttatgaacaaaatcggattgccaggagaaagggtgtatgcattcatacttgaactgagcattggttgccagatggctcttcagaatggctgtgcaagtctctattcctaccagcagcactgaagaattcctatttcctcacatccctccttccagaatatgattttatctcatattataatacttgccaatataatgggtataaagtagtattctactgttttaattaatgtttctctaattactgatgaaattaagcatctcatatgccagccattcagctcttgcactcactcttaggagtttcttatgtgacctttcagagataggttaaacatatacaagcatatttgcaaatctaatgagaaaatagtgtacttgtcactatacattgccctttaagtgctgctttatctgagtcccacagatttggacatgtattgctttcattatcattcagtattttatattttaagaattctctttaaccctaaaataatgaagtagtatgttttttctttccagtcatatgggatttttttagagctagtattttgttactgattattgatttgatgtaatttgattaaagaaaatgattggaataatactcattctttgaaatttattgagactccttgtggtatagtacagagtagatttttgtgattttcccatatattcttggaaagaacgtatattctctacttgttgagctattctttataactttgactatttttgtctgcttgaactatcagttactttcagcattgtgtcaaaatttccaactaccattacagtgtcatgcatcatttaataaggagggtacgttctgagaaatgggtgccgattttgctgttgtgaaatcatcatagagtgtacttacataaacctaggtggtatagcctgctacacacctaggctatatggtatagcctgttgctcccaggctacaaacctgtacagcatgttattgtgctgaatactgtaggcagttgtaacacaagggtaagtattgtgtgtctaaacatatctagatgtagaaaagatacagtaaaaaaaaaaagagaaaaaatggaatacctgtataaagtacttatcatgaatggattgtacaggactggaagttgctctgggtgaatcagtgaatgatgagtgaatgtgaaggcctaagacattgctgtatactaccagatgctttataaacactgtacacttgtgctatactaaatttattaaaaagtatttttccttcttcaataataaattagccttagcttattgtaactttttactttataagatttttaattttgagctgccatcttgcgtccccatgtgtgtgcacctaatctcagctggtggtccacccgagacccccaagcaccaaccctagccccccacgttggccccttatctgctctgagaagatgaaacaaacagttatgagccaggaaagacttgccaaactgcaggcacaagtgcgcattggtgggaaagaaatggttcacagaaagaagaaggcggttcatagaacagccacagcagatgataaaaaacttcagttctccttaaagaagttagaggtaaacaatgtctctggtattgaagaggtgaatatgtttacaaaccaaggaacagtgatccactttaacagcagagatgccagcaaactctttcaccattacaggccatgctgagacaaagcagctgatggaaatgctacccagcatcttaaaccagcttggtgcacactgtctgactagtttaaggagactggctgaagctctgcccaaacagtctgtgaatggaaaagcaccacttgctactggagaggatgacgatgaagttccagctcttgtggagaattttgatgaggcttccaagatggagaattttgatgaggcttccaagaatgaggcaaactgaattgagtcaacttctgaagataaaacttgaagaagttattgggagctgctattttatattatgactgctttttaagaaatttttgtttatggatctgataaaatctagatctctaatatttttaagcccaagctccttggacactgcagctcttttcagtttttgcttatatacaattcattctttgcagctaattaagctgaagaatcctgggaatcaagtttgaaacaaaggttaataaagttctttgcctagtataccaaaaaaaaaaaaagatttttaatttttttaactttttgactcttttgtaataccacttagcttacaagtggtattatgagtgaatgtgaaggcctaagacttatgcagctgtacaaaaatattttttccttatattcttattctataagctttattaaaacctttttttacttttaaaattttttggtaagaatgaagacacacacacacacatgcacgtgcgcacgcatctaggcctacagagggtcaggatcatcaatatcactgcctttcacctccacatcttgtcccactggaaggccttcaggggcagtaacagtcatggagctgtcatgtcgtataacagtgccttctgctagaatccctcctgaaggacctgcctggggatgttttacaatgagcctttttcttttgtaaatagaaggaacaaacttgaaagtaattattaaaagtatggtatagtaaatacataaaccagtaccatttattattatcaggtattatgtactgtacataattgtatgtgctatacttttatatgactggcagtgcagtaggtttttttacatcagcatcaccacaaacatgtaagtaatgcctgcatgtagacattatgatggctacatcactagggtgtaggaatttttcagttcattttaattttatgggaccattgtcctgtatgtggtgtgttgttgactatagcagcattatgtggtgcatgactatattgatttatctgtttctcaacataggcctctgtattagttctttttcatgctgctgataaagacatacccaaaattgggaacaaaaagaggtttaattggacttaacagatccgcatggctggggaggcctcagaatcatggcaggagacaaaaggcaaaaggtacttcttacatggcggtggcaagaatgaggaagaagcaaaagtggaaacccctgataaacccatcagatctcatgagactttttcactattacaagaatagcacaggaaagaccggcccccatgattcagttactgtcccctgggtgtgggaattctggtagctacaattcaagttgagatttggctggggacactgccaaaccatatcagcctctcagtttttgcttgtgttttgaggctgtgaaatatatacagaatatttcataagtggtgtatacaattgattatcatcattcatgcgttctgtatttgtggatatgcctatgtctccttgctaaaattgatttgtaaactcaaaatcaatacagtgcttttgtggtcactggtagacatgtggagagtgatctactactttgagtctcccaatgcacatgttgccacctcagaccaaataaggccacactctcccttcttgttttagctctcatgctttaaacaagtattcttttcatagtctatttagtgcctgaatgcctgctataggtaaccaatctcttcagtttctggtttatctttcctgcattttttatgtacaaagtagatacatacatatgaatttcatatatcttctttattatatagagggtggcatactacagctactcttgtactttttattttttttaagagacaagagtctcactccgtcacccaggttggagtgcagtggcacgatcatgatcatagctcactacagcctcaaactcctcgcctcaagggatcctcctgcctcagcctcctgaatagctgggactacaggcacgtgaccaccacatctggctaatttttaaatgttttgtagagatggggtcttgctgtattgcccaggttggtcttaaactcctggtctcaagcgatcctcctgccttggcctcctaaagcactgggattgcatttgtgagccattgtgcccagccatactttgcttttttcatctaaaaatatatcttggaaatcactctaaatcagtttatagagatctttctcatccttgtgctttattgtgtgagtgcatcatagcttagcgtctctcctgtgtatggtcatttaggttgttcctaatattttactattacacacatgctacagccttgtgcatatttattttcgtattgttggaagtgtatcttcagggtagattcctagaagtgggtcaaaagttaaatgaatgtgtagttttgtcagtttggccaaattgtttttttactatgcaaattatattattattattattattattgttattatttttgggatggagtttctctccaggctggagtgcaatggcgctatctcggcttacttcaacctctacctcccaggttcaagcgattcttctgcctcagcctcctgagtagctgggattacaggcacctgccaccaggcctagcaaatgtttgtatttttagtagagaagaggttttaccatgttggccaggctggtctcaagctcctgacttcaggtgatctgcctgcctctgcctcccaaagtgctgggattgcaggcgtgagccaccatgcctggcctattttcatttttgtgtggtcaaatttacccatcttttattttattgcctctggatttttagtcattagttacacagttcttacctacaccaaattttcacctacaccaggcttaagaagaactcactcatgttttcttctagaacttgtgtggctttttctttttacatttagattgctcatccttttgttgtttattgtgctttgtgtgagatgtggatctaactttatgtttttttttttaaatggcaaccacttgtcccagagccatttatttaaaagttcatcattattactgtgatttgagatgccacctttattatttaccaaatttttgtaggtacttttatactatatctgtagtataaaattccactggtatgtttatctacataaggaccagtaccactgttttgattatagacattttatagtatgttttaacatctggtagggatagtctgccctcatagtgtctctttttagtgttttcctggttattctttcttgcatgttcatttttccatgttaattttagtgtcaacttgtctaactccataaaatagcttgtttgtatttttcttggaatttcatgacttataagttaaattagggagaactgtaatcttttttttttttttttttttttttttttttgagacagagtctcgctctgtcacccaggctggagtgcagcggtatgatcttggctcactgcaacctctgcctcccaggttccagtgattcttttgcctcagcctcccaggcagctgggattgcaggcacttgccactacgcccagctaatttttgtatttttagtgagacggggtttcaccatattggccaggctggtctcgaactcctgaccttaggtgatccacctgcctcggcctccccaagtgctagtattacaggtgtaagccattgtgcccggctgagaactgtaatcttttcatgttgatttattctatctaagaacaagggatgtctttccattatttcatgtctacttttatgtcttatagggacatttaaattttttccttgtatggattttgcacatttcttgttaaatttattcctgtgtctttaggcctctttgttgctgttacaaatggggatttctccaccgtgatgttctgttgattttttctgtataaaaggtctatttttgtttgtttgttttgagacagagtttcgctcttgttgcccagactggagtgcagtggcatgatcttggcttatggcaacctccgcttcccgggttcaagcgattctcatgcctcagcctcccgagtagctggggttacaggcatgtgccaccacacccagctaattttgtatttttagtagacgcggggtttctccattttggtcagggtagtctcgaactcccgacctccggtgatctgcccgccttggcctcccaaagtgctgagattacaggtatgagccactgcacctggccctattttttttttttttaaagatggagtctccctatgttgcccaggttagccttgaactcctaggctcaagtgagccccctgccttagcctcctgagtagctggaaccatatgtgtgccgctgtgccccagggctattgattttgtatgttaattttatatcctgctagtttactgaattattttattatttgagttagttttatcattgattttggggggttatatctgcaaatagagatagttttattttttctttacccattcttaaccctctaattgaggtgtaatcccattggctgatacccttacaccagttttgaacagtagcagagatagtaaatattcttgccttgttcctggtcttagtgaaaatgccgttagtgttttggaattaagtaaaatacaggttttacgactaatatatatgtgtgagtggctgagagagttctagatatttagatagaacatgggaacagagattagagagagatttctatgaaggcttgtcaaattctagggcaataagtatatcacattcaaaaggtttcatttttcaatttgggagtaacaatgagatatgccattacagcaagtcatttgaattatataaattgtgtttatgcattataatggtcacaaagaaaattttatgcttgaatttgtcttgtagtgtgtgctgtatttatggagtttaaagattaatcatcccaaaacattgtttctgcttcggggaaatcatgaatgcaggcatcttacagactatttcaccttcaaacaggaatgtaagtataatcactcctctagaacctttttagttaccctttaacctgtccgaagtaaatcaaacagaaagaaaaaagaaactaatagaatttaaatgcttcctgtcctgttgttatttttttcacctgcaaagaactaagattctatcttctaaaacatttattttgaaaataacttttgggttcccccttgtttataaaataaataattcgggatatttggaaagcacagagaagtctaaagaagataaaagtgtccataatcaggttgcagtgagccaagatcacgccactctactccagcctgggcgacaaagcaagattccatctcaaaaaataaaataaaataaaagtgtccataatcatgccacttagaggtaatcactgttatcacactatttgaaatatggtcttccattcttttttattattatgaaatagttcaggtatacatatatctgtatatattttacaaataaaattgggctcatatgtactgtttaatacatttctgtttcacctaatgtagtagcattttttccatatcattaagtatttttgacaacatggtttgtaagtgttattttagtttttttaaagtattccatcttacgaacacacaatcatatatgtagccaatttagtaacaatcataggatatttaggttgtttctaactgtgactactgctgtaatagtaaaaataagtttaatataaaagtagaattattggccgggtgcggtggctcacgcctgcaatcccagcactttgggaggccaaggcaggtggaacacaaggtcaggagttcaagaccagcctggccaacatgatgaaacccctgtctctactcaaaatacaaaaattagccgggtgtggtcgtgcgtgcctgtaatcccagctactcaggacgctgaggcaggagaatggcttgaacccgggagatggaggttgtggtgagatcctgccactgtactccagcctgggcaacagagcgagactccgactcaaaaaaaaaagaaatagaattattttgaaagtcaaaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcaagactccgtctcaaaaaaaaaaagaaaaaaaaaagaaagtcaaaacattactagctgattttaaaaaacagataacatggtgggaggctgaggctagacgatcccttcagcccaggagttctacaccagccttggcaatacagcgagactccatctcaaaaaaacaaactcgtagatttccttgactagcatctagtactcataattggctgctcactaacaaacagtatgatgctgactatgttggggatgtttgggagatcctgccccagggcatttgcatttttagttcttcttttcccagatctctatctgcgtataagacatacattctatttcattcatgtcatttattccgagattttctcctctagttgcttttctaaatcataatctcatcattttaccctcataccctgtttcttttcatagtgtttatcaacacctgagatttatgtgtatttatttgttgactgtctttctctgccaccagaatgtaagctccatgctagcaggggtgtgttttgttcactgttgttttccccaacacccacaacagtattagttgctcatagaagttgcttagtaaatattggttgagttcatttgaatgaatgagcatctgtgatttgtatgtttagaacacactcttgaaaaagaatttctgggttagggggcaggcacattttaaagacttttggcatactctaaagtagtcttccagaaaatatgtatattgggttatacgccaaaaaaattttttatttttgtgatgaaagtactgaaataaaagcaaaattttacctgttttgacttctaaaattttagcatattctctataaaataaggaagctaaactaaatatcttgggtcccatctggctctaaaatctaccccttttaacgaatcctgaatatataaatatactttagtgttcatatggttgatattttgatcatggatttcattttgtatccagatttttctgcagattattatcttagaaaaatatattataaaatatttaaacttttattccaaaaataattttcaaagttaaaaaaacttttacatttgttttcagagactcaaagtttattaatctgccacagatccctttactgataggtagattgctatttatagtgtttcatatgctcatatgaattcttgctaccagtatcttcttacattggagatagtagttgtaatgaaaacatccctcctagtagagcctcaaagaaaaggtctttgttattaaaagaaattttagaggataatcacttcttaaaaagtccctctgtcaaaagtcagctgcaagagggcaagatacaaatccttccagcccttggtgacttactggaataaacactttaaatcagcagctaattaccaggaagttttaaatctactgttggtggatgtttaaattggtgtaagttgagcatggtggctcatgcctgtaatcccagtacttttggaggctcaggtgagtggatcacttgagcccaagagttcaagaccagcctggtcaacatgttgaaatcccatctctacaaaataaaacacaaaaaattagctgtgcatagaggcacttacctatagtcccagctactcaggaggctgattgaggtgggaggatcacctgagctcaggagtttgtggctatagtgagttgtgatcaccactacactccagcctgggagacatagtgagaccctgtctcaacaacaacaacaacaacaacaaagatgtgaggtatttgaagagcaattttgtaatatatttataaattttaagtgcatgtccccttgatctagcaatttcatttgtaggaatttattatgcagattgtgttactttttaaatgctgcataaaaaattatcacaaatttagtggctaaaaagaacacatttattatctcatagttattgtaggtcagaagtccaggccacagtgtggctagattctctgtataggatctcactgaaatcaaggtgttgccagggtttcagttctcatctggggcttagggtctttatccaaggtcacttgttggcagtccttgtaactgtaggattaaggtccctgttgtcctgttagttgttgaccagggatgactcttagcttccagatactgcttgcagttcggtaacatgtcgccaccagtggtagttcccaatatgaatgtttgcttttttccaggccagcctgaatgcatctctctgaccttctcttctgtgatcagctagctggaaaaaaaccctcactcagtttttaaaaggctcaccttaggtcaggcatggtggctcatgcctgtaatttcagcactttgggatgccaaaggggagaggatcacttgaggccaggagttcaagaccagcctgggcaacatagtgagacctcctctctgccaaaaagaaaattaaaaaactagaattcagtcagcctgcatggtggtacaagcctgtagtcccggccagttaagaagctgagactgaaggatagattgagcctgggtgtttgagattacagtgggctatgattgtgccactgcactctagcctgggtgacagagtgagaccctgtccctaaaaataaataaataagtaaataaatgttcacctgattagatcaggccctcccaagataatctttcttttgccatataatgggacaaaataatgggagtctcatcatacttacagttttcatccactgaaagaggagtggattatacatacaaagatgtaggtcaatgcaggtcattttagaattcgtctaccacacagatatactcacaaaaagatagtaaaatatggatgcttaaggatgttcactgcagtgttaattgtaacaacaacaacaacaacaaaaaggtaatctaaatgtcaacaagacagtgatgaaataagtgataatatgcttttgaacaatggaatgctaggcagctattgaaagaccaaggtggccgggtgcagtggctcatgctcataatcctacactttgggaggccgagatgggggcattgcttgagcccaggagttcgagactaacatgggcaacacagtagtaagactctctctctacaaaaaatttaaaaattagctgagtgtggtggcatgtgcctatagttgcagctacttgggaggctgaggcaggaggattgcatgagcccaggaattcaaggctgcagtcagctatgatcaccacactccagcctgggtgacagagcaagactctgtctccaaaaacaaaagacaggcagaccaaggtagacccataatatgtactgatatggagagatgctaagatattttataaggcatttgcagagcatgtaaatggtcatctcctttgtaaattaaaaatatataatgtacagaagaaatcattaacagtgggaggttgggttaggaggacttagagggtttttttgttttgtttttgttttgtttttgtttttttagatgcagtgttgacatgttgcccaggctaatctcaaactcatgcaatcctccagccttagcctcctaaatagctgggactataagtgcatgccatcgcgcatggcttacttttaattttatatcctctctagtattgtttgaattattttttaccaccactatgtactacttttataattattattatttttcaaattggtaatttaaaaattacccagttggggcccaagcatttgaaaagctttgtaagcacccaaggtagttcagctgtgtgctgctggttaagaacgacggctctggagtctttaggaagcttctactatctgtcgtttgggaaccacttcaccaaatacaaaaatgggaaatattttattttatattatttttctaaaccaaattttagggtattccttaacaccttcatttcttacctgggaaaattaaataatgtgtataagttaacaaatgccctggaatgtaatactcgataaaagctaattttatgaattaggagtagatacgtagtgaagaaagctgcctatggctgcctttgttttgaattaagtttcagagggttttttaggtgacatttttcttaattattcttttgtcttatcagattttttttatttttaatttttatgggtatatagtaggtgtatctatttatggaatacatgagatattttgatacagggatgcaatgtgtaataataacatcagggatttttttgacagactatttttagaagatggaacaataggtcctggaaacattttaagtatctccttttgcccagaatttcttaccttaggtttttatttgcttttcacatgatttaactgtagttaaacctgatggctttctttttctcctatctaccaagatattccttcttttttattataatgctgcatctgaaatgtaaataaatcttggaacaagcacacagattcaagtataagtttaaaattttattcttgtataaggagagagcatgtgtgttgctctgcatgggtgtttttactgataagctgatctctcttcagtggccactgtggcttttagaactagcatcttatcattaataagggaggcttagtttcagattgtgcagctgtaatcttgttcatgtttttaagagggaggtgggtgaaggcttttcttgtatcaatcttaaattgctttataatgcagagattttttaaaaaatattcctttctttatggaaaagtaataatgtttttttttaaattgatgtataatagttgtacgtatttttgaggtacatgtgatatttttactatatgtatacaatgtataattattatcaagtcagggtaactgcagtatccatcgcctcaaacatttattttttctttgtctaacagttaaacaaaatttatttttttaagagacagggtctcattctgttgtccaggcttgagtacaattgtgtaatcatagctcactgcaactttgaactcctgggcttaagtgattctcttgcctcagcttcccgagtagctgggactgtaggtgtgtgccaccatgcctggctaatttttaaattttttgtagagactgagtctcgcctatgttgccaaggctgaacttgaactccccaaaggatccttccgccttagcctcccagagtgctgagattacagatgtgagctgccatgcctagcccctaacagttaatttttgacatatcatttgtttttgcaaaaatatttcttcattgttatgtacttagaaagcaagaaacatagtgcctgcctccctccctccttccctccctccctccctccctcccttctttccttccttccgtcttgctctgttccctaggttggaacacactggtaaaatcattgcttactacagcctcaacctcccaggctcaagtggtccctacacctcagcctcctgagtagctgggactacaggcacgagctctcatgcccagcctatttttatgtttttatgtatttatttatttattttctttgaaggaacctcgtgtttatattattccacaaatactctgggtgcaacctcatagctctggatcagagtttctaaagtaaatgaatttcttatttccacgaacctattttttttttttttttttttgatagggagtctcgcttcgtcacccaggctggagtgcagtggcacaatctcggctcactgcaacctccgcctcccaagttcaagtgattctcctgcttcagcctcctgagtagctgggattacaggcacgcaccaccacgcctggctaatttttatatttttagtagagacagggtttcactatgttggtcaggctggtctcaaactcctgacctcgtgatccacctgcctcggcctcccaaagtgctgggattacaggcgtgagccaccatgcccggcccttccatgaaccatttttttaaatgtatagttaaatagcttactgacaagttccagaaactcctgtaattttactaatgaaagcagtattgttatgacaactggattttttaaaaaaataaatactgtttgtcattgctcattgcagcattttttagagtagcaaaagattgatctaattagattgtggtatatccataaagcgaaatactaggtaaatgttaaaaaaattacaaagctctcctgtaggggaggcaaaattttacctttactctcagggtttttcagctgggcctgagaattaaattgacatgagataaattaataggagaagagcatataaatttatttaatataagttctacatgacataggagccgctataaggaaatgaagatccagagactcagagttgaacacttacatgctgaatcggacaaaaagtagtaagttgtgaaaaagtaactaaatgatgtgaggaggctagaagataagagttatttgaattcagtctcaactattaatccttggtgataacaatgttattttccttctagtacagggagggcatcttttcttttttttttttaacttttattttaggttcaggggtacatgtgcaggtttgttatataggcaaacttgtgtcataggggtttgctatacagattattttgtcacccaggcactaagcctagtacccagtagttattttttctgatcctctccctcctcctaccctccatttttaagtaagtctcagtgtctgttgttctgggagggcatctttcaaatgggaatttcatctcctgcttttaaaaagcagcatgagccaggcactgtggcacgtgcctgtaatcacagctacttgggaggctgaagtgggaagatcgcttgagcccaagagtttgagaccatcctgggcatgtaacaagaccccatttcaaaaaaaaagaagaaacagcatgaaggccagagtgatcttcttgtacgtgtggtttttcaagtgcctttaactcaaagttgtcagtgtgccagagtggtgtattttggggtggcatattcttaactccactcttcatctgaagatgtggcatgatagccaaaatacgttcttaagtacgaaaagcaagtaaagaacagtacatatatgctatcatttatgtaaaaaccaaaaggatgttttggaaagagaagaaacatatatgtctgcatgtgtatgcatagaacatctttgtaaagacacccaggaaactggtaatattggttacctgcagagagagggcaggaggcacattatacccttttgtggcttctaaaatttgagctatgttggggccaggcacagtggctcacgcctgtaatcccagcactttgggaggccgaggcgggcagatcacaaggccaggagattgagaccatcctggcgaacacagtgaaaccccgtctctactaaaaataaaaaaaaattagccgggtgtggtggtgggtgcctgtagtcccagctactcgggaggctgaggctggaggatggtgtgatcccgggaggcggagcttgcagtgagccgagattgtgccactgcactccagtctctcaaataaataaattaattaattaattaattaaattaaataaataaaaaataaaaaatttgagctatgtctcacgcctgtaatcccagcacattgggaggctgaggtgggaggatctcttgaggccaggagttctaggttgcagtaagctatgataatgccactgcattccagcctgggtgacagaatgagaccctgtctcaaacaataataataaaaaataaataaagcaaataaaaattgaaacaaatatatcatcagtgactagaccagattgtgatttcttgcaagtagtgctgactctcaaaattgctttcagataattttgttgaaaattttgttttgttaatgttgtattattgatactagttagaacttgtatcagtgtcatcctgtggctgtaatgcattttcccttcactatagaaataactgttttatgggatatatcctaaaatttgtcttgaaaataaagcaattgaatcagctaatttaacctctgggaattatgtatttggctatttagattctcctattcaaaatcttatttaaaaataatgattaggaggaatattagagggtcattaagagcatgaacaggtttaagtctcagttctgccagttacttgcttgcagctttgggcaggtaagcctaatttcctcagtttttaaatgaagacagtaataatacctacttcacagggtttctgtgagtattaaatactttcatcagttaacacagtatgtactaagtgccagcattattctgcatattttacataaatgaattcatttaatcctcacagcaaccctgaatctactgtttagggtgttattattattatgaccatagataaggaaaccaaggcacagagagttaaaatttttatccaaggtcccatagctagtatgtggagggggctgcagttcttcaaatcaggcaacaagttccagactccattctcttcaccaccatgccatgccaaatgcttaactcactgacagacacatcatgagccttcaatacatttaaataataaaggtaatataggccaggtacaagtgcagtacctcatgcctgtaatcccagcactttgggaggctggggcaggaggattgcttgaggccaggaattgaagaccaacctgggcagcatatcgagaccctgtctctacaagtaatttttaaaaattagctgggtgtggtggtgtgcgcttgtagtcccagctacttagaagattagacaggaggaccacttgatcctaggagcttgaggttacagtgagctatgattgcactactgcactccagcctaggcaacagtaagatcctgtctctaaaaaaatttttttaaaaggtggtataataataaatgttattatataaagattacatattcatcataaaaaagaaagaacagctaaactaagaaaaatatagataccattgtcagtctaacccctcagaaaattaaatactggtaattatatatgcaattcatatactttgaaaaaataaacatggtgatatttcatagcctattttattcacatattaatataacatgaacttctttttgcttaatttttgacctcctgttttaatttacaaaatgacaatacacttccttacttgtccagacttggcattcttttttggaagtaggctaaggaattattttgagtcattcttgggattgaaaggcatttatcaatgtaagatgttatggagcataaattaataagtaattgaaattcctacctctattcaagtgtggaactcccatggaggaattccttactgacactggcaacagagggaactctggttcctaggattttcaggagaaaaagtcaatcactgaccacaaattaaagagttttctgtttgttttttacttccaacagactttatggccaatgctggatctactttgaaatgggcaaaatttaaaacaaagcagagtataaggatgtaactgtaaggagaggcaatgatgcataagacatggttcttgtgaactttgagctcctaataaagttagcatatgttgtggaatagattatgctgactgctacaacagcaatacaaaatgttctgaaaacctcaaagaaacccacaggctcccttaatgaactcaaaccctaatcacccagtattggcgttaaagagaaatcttcacactcagggatggaaggccttacaacctcaagcgtggtctactggtttacactttccttagggatctctctcttaatcattcctgccacccatatagtactgcagtctggcccaaatctggacccatcattcttcactttattccccaaaaccttgccaggaccaggctctgatccttaaatatgtctttctaaaggcttagagatcacaaaaaggaaataaacacagaaataattaccaactagatagtctgactcactcgatacagctttggtctcttggtcctgtaggccacctcatcttcccagaatcctggaagaggagaaggagctcacggttctgcagggttgcctgactatatttctcgtcttctctacccacacacatccctgagcacagcttgactttttgaaaccaaggccaaggaagaagaaaatgttcctttttctctttaaacacccattttccagtttcccacctattatttcatgacttttcctttccagagatttgtagagactcctccttccacccactgatgtatttccttattctgtagccccaagttgacagccacatcaaaatataatttattaagccaaacatttattttttattgtttagagacagaggctcactctgttgctcaggctggagtgcagtgacactatcgtagttcactgcagcctcaaactcctgggctcaatctatcctcccacctcagcctcccaagtagcttggacagcaggtgtgtgccaccacagccagctaattttgtttttcaattttctgtaaaaacgaggccttggccaggcgcagtggctcacgcctgtaatcccagcactttgggaggccaaggcaggcggattgcggggtcaggagtttgagaccagcctggccaacatggtgaaaccccgtccctactaaaaatacaaaaattagccgggcgtggtggcgtgtgcctgtagtcccagctacttgggaggctgaggcagaagaattgcaagaacccggaaggcagagctgcagtgagctaagatcccgctactgcactccagcctgggggacagagcaagactccgtctcaaaaaaaaaaaaaaaaaaagaggcctcactgtgttgcccaggctggtctcaaactcctggcctcaagcaatcccccgacctcagccttccaaaacattgggattacaggcgtgagccaccacaccagtttaagccaaatgtttttagagaaaatagaatcaagacataatttgtttacagaccttaaaaattatgagcaaaaacattattgacattttattgatgtctcttaagactccagtttccacttatatatcttcaacacccctaagagatctttaagacccaataaaatattcagactcacaagactaccatggaccctagttgtcatccatatacttaaaaggatataggtcaggaagggcagcactgggcattccttttcagtggagtggtcctcacaggagtgcataccgcagtccagcagctttccatctctcttgccccctcccatcttctcaccagctcaggtacaaggaaatatccacagtgggaagattagggagccatcctggtatagaagcctcgtgcatcaaaaatgtcaatgtgtgttgtaaaactaccttcagaggagcccaaagctatagcttcccaccaggtaactgggtaatttttaccacaagccatgttgcctaataacacagtggacagtcaccttatcacatttccaagcaacagagctggaaagttaatccaaggtcacacttgtctttaagaggagagaggtattgttaacctattatccacaacttttcaaaagtatctttacaaagataattgtgctttcaaatcatctaaaataaatggctctaaagtagcttcatattctcctggcctatatcctttttcaaatgtgatacgttttagttcttccattgactggttttccttttttgttaggtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaagtaagtaatcttttattattctcacagggaatatttttaaaatgtgttgggtttttttgttgttgttgtttgctttgagacagagtctctctctttcacccgggctgaagtacagtggtgctatctcagctcactgcaacctccgcctccctggttcagcctcccgagtagctggatacaggtgcacaccaccacacctggctaatttttgtatttttagtagagacggggtttcaccatgttggccaggctggtcttgaactcctgacctcaactgatctgcccactttggcctcccaaagtgctgggattacaggtgtgagccaccgcacgcctggcctaaaatttgtttcttattgcagtcaaccaatatatctttagctgaaatctttaaaatatagataatgaaaagtaagaaaatggaagttacctctgatttcatcactataactactgttaacattttgatatgtacctaccacaaattataatttttaatgagctctatgtttttaccaactagaaagctaacattcttgtagtatagtcctgaaactttgaattatatcgcagtgcaaaaggaaggaaaccagggttctaatcacagtcctgccattaactgtgtaaccttaaccaagttattgaacctcttagtcacatttcttctctatgaaatgaggaagttggaagggatggtctgaggacactgccagctccgaaatgcattggctttgacattttagatgataacggtttcattgttttacttgccttccttggtgattattatttccaagattctgtatcttcattatggaaaaagatgaccaatttttattgtacatggttgtcttatcttctctacctttgaattcttctacctgtctctctgtcttttttaatcaaagtgatagatactcatcctctcttacaggtactgagactaaaaatttttctgtttataaaactattttctctgaagaaagtctcctcagggtaagagggtgtacctatatgtactggctttcctcttgccttactgtcttttaagtaaccagcatttctcttttacatagtaaaatatgaattttataattctgaatcaattgtatcaataaaaagctctttcacgcagtagaaattctcttcttggcattcagctattctattacttgttttctcttggtttttatgctttcaactaaagcagcagtgactaaaggcttaagttaataactcatattgaaatacctcaactgcatagactggaaaggataaatgcccttacaaaattagcattctttaaaataaagaaatctccactggaatgaggtttgcaatgaacagaaccattgtaaaacatttctgctgtcatggtaacattggctcacctagacaaataaaattaattttatatagtcatagtctttctaaaatagtatatctctatagtggttgatttcacatttgaattaaattagcactgctttacgattaggatgtaagagggtcttttactacagtatggttagatgacagggatgtttataaaaatttattgcagaccgggcgcggtggttcacgcctgtaatcccagcactttgggaggccgaggagggcggatcacctgaggtcaggagttcgagaccagcctgaccaacatggagaaaccccatctctactaaaaatacaaaattagccgggtgtggtggcacatgcctgtaatcccagctactagggagggtgaggcaggagaatcgcttgaacctgggaggcggagtttgcggtgagccgagatcgtgccattgcactccagcctgggcaataagaacgaaactccgtctcaaaaaaaaaaaaaatttatttcagaaaaataataaaaattatgtatctaaaattgttaagtgttccttttcttgcaggaaagtcctttaggggcacactggcttctctcctaatacattcttgtgggtgaaaggggtttttctttgacacatactagtttccaagaagccttttgctctcctgatttttttcttttggcttttgtgtgtcttctagttagacaggtttacggaacctcccgcctttggacctgtgtgtgacctgctttggtctgatccctcagaggattatggcaatgagaagaccttggagcactatacccacaacactgtccgagggtgctcttatttctacaggtaagctagtccttgaggtcgaaaattatgaaaggaaactgtaattcattttatcagatgatttttcagcattttatatttcaaatctatgtagtataagcactcctgtttaatttttcgattaataggaggcaagaaacttgtttgtttgttggctttttatattttcttaggtatatatcctaagaagtgtaatacaccaaacatgattggacatcctgcagtgctctgatatttttgtctgactctaagtgatctagactatttgttcctaaacattatctatacacttttttaaaaaaaattaaagctttcttggctctttccccagagattctaatacactaggtctgagaggaatcctattgtattttcaaaagctctccaaattttgtaaccactagtatagactaagatataaaaagaacaggacattgtgaactaagcccagtacatttcctggaagttggctgttgttttaaatttcacaggagctttcattatgattagacactcaaaaataggaagacaggcagggcgtggtggctcacgcctataatcccagctctttggggtgcctaggcgggcggatcacttaaggccaggagttcgagaccagcctggccaacatggcaaaaccccatctctgctaaaaataaaaaaattagccagatgtggtggcaacacgcctgtaatcccagctaattgggagacttcaggcaagagaatcacttgaacctgggaggtgtaggttgcagtgagccaagattgtgccactacacaccaacctgtgcaacagagcaagactctgtctccaaaaaaaaaaaaaaaaaaaaaaaggaagacataagagaagttggaaatctaaattatttttaatcccagtattttattgtggcaaataatacatatgtttatttccctaaaaatctctgttaattggctaagataatgtgttcattagaatacacacatgcacacacacatgaaactttgatttcgccattacttttagcattcttctaaacaacctttttttctttaaaaaaatattttttaaaatttttgtgggtacatagtaggtatatatatttatgggttatatgagatattttgatatagtcatacaatgtataataatcacatcaaggtaaatgagttatccatcacctcaagcatttatcctttgtgttacaaacaatccaattattactcttttatttattttattttttgttgttttttttttcacctttttttttttttttccttttttgagacggagtcttgctcggtcacccaggctggtgtgatctcagctcaccgcatcctccacttcccaggttcaagcaattctcctgcctcagcctcctgagtactgggattacaggcacctaccaccatgcctggctaatttttgtgttttttagagatggggtttcaccatgttggccaggctagtttggaactcctaacctcaagtgatccacccacctcagcctcccaaagtgctgggattacaggcatgagccactgtggccggcctcttctagttattttaaaatttacaattaaattattattcactatagtcaccctgttgtttaaatctcacagtatcaaatactaggtcttattcattctttctgactgtttttttcgacccattaactatcccatttcccctcttactacccttcccagcctctggtaaccatcattctactctcatctccatgagttcagttgttttaatttttagctcctacaaataagtgagaacgtgtgaagtttgtcttcctgtgcctggcttatttcagttaacataatgacctccagttccattcatgttgttgcaaatgacaggatctcattcttttcaatggctgaataatattccactgtgtatatgtaccacattttctttgtcctttcatctgttaatagacacttaggttgcttccaaatcttggctattgtgaacagtgctgcaataaacatgaaagtgcagatgtctcttcaatatactgatttcctttcttttatatacatacatagtagtgagattgctgaattacatggtagttctgtttttagtttttttgaggaactccaaactgttctccatagtagtgtactaaacattcccaccaataggatatgagggttcccttttctcgacatcctcaccagcatttgtcattgcctgtcttttggataaaagtcattttaactgggtgagatgatatctcattgaagttttgatttgcatttctctgatgatcggtgatattgaataccttttcatatacctgtttgccattttatgtctccttttaagaaatgtctattcagatattttgctcatttttaaattggattattggatttttcctattgaattgtttgagctccttacatattctggttattaatctcttgtcagatggatagtaaaaagtctttttttctttcttcttcatttattttattttatttatattttattttattttgagacaaggtctctctttgttacccgggctggagtgcagtggcaccataacagctcactacagcctcaaccttctggactcaagcagtcctcttgcctcagcctcctgagtagctggaactatgggcatgtgccaccatgcccagctgctttttttattttctgtagaaacaaggtcttggctgttttgcccaggctggtcttgaagtcctagactcaagtgaccctccctacttggcctcccaaagtgctgggattacagggatgagccccacccagccaacaaccatttttcattcctccatgccaacttttccagtgactaatgtgatgaaatcatttaacttttatttctttttacattgcttaaaataaagagcataatacatattcattgttgtcagaatagaaattggtacaatttctgtggacatcaacttggcaatatctttcaaaggtatttgtacatggcctttgatccagaaattctacttctaaaacttaatcctgtagatatataattgattctcattacttgtggatttcatatttgtgaattcccccacttactaagatgtatttgtaacacccaaatcagtacttacagaggtttcataatcattcatgggaatgtagtgtgcaatgcaacaaaaaatttgagtcacctcactcacatgttcctagctgaggttgaacaaaatgatgccctaccttctttttgcagccctcatattgtaaacaggcattcttttgagttttatttagtgaaagatgttttatgtttttgtgcttttcatgagtgatttcactgtttagaatggccaccaagtgtagtgctgaagtgctgctgtctagggtccctaagcacaaaaaggctgtggtatgtcttacagagaaaatatgcgagtgttagatataagctttgtttaggcatgagttatggtggttttggccatgagttcaatgttaatgaatcaacagtgtaaatgacctaaagtattattacacagaaacacatctgaaacaaggttatatattaattggtgggtgaaaatgttatgaccggagcctcacaggaacttcaccctgtatttcccttagcagtagtgtttcattatttgctaattctgtttttgcagcaacattatagaatgtagctactgggaataatgagataaaaaatttgactcacccagcacacatgttcccagctgaggctgaacaaagtgatactctgccttcttttatcccagggataaatcccatttagccacagtatataatacttttagtatgttgttgagtttggctttctagtgttttatggaggatttaaaaatctatgttcatcagagatactcacctgtacttttctttcttctggtgtctttggctttggtatcagagtgatgctggcctcataatgtgagtttggaagaattctctcttctattttttggaaggtttaagaaagattggtattaattcttttttttaatgattaatagaattcacccatgaaaccatctggtcctgtgcttttctttgttgagagctgtttgattactgattccatctccatatttgctattggtctgtttgggctttctatttcttcatgattcagttttggcaggttgtatatttccagactctatccatttcttctgggttttccagtgttttggtgtgtgattattcgtaatagtccgttatgatcccttttatttctgaggcatctattgtaatgtctcctctttcattttttgttttatttatttgagtatctctttttttcttagtcttgctaagggtttgtcaattttgtttagtttttcaaaaaccaactcttagttttgttgacttttttctgttgtttttctattctctatttgattcatttctgccctaaactttcctttcttctgcttactttgggcttatttgattctcctttttctagtttcttgaagtgtaaaataaggttgtttaattcagatcttttttgttttttaaatcggcatttattactataaactttcctgtaggtactgcttttgctgcatcccatacattttgatatgtatatttttgttttcatttatcttgaggtttttttttttttagataggatgttttgctctgtcacccaggctcaatgcagtggcacaatgatacctcactgcaaccttgaactcctgggctcaagcagtcctcctgcctcagcctcctgagtagctgggactacaggatgtaccgccatgcccagctaattgtttttaaaatttttagaggagatgaggtcttgctgtgttgcttaggctggtctcgaactcctgacctatctagagataattttaaaattcctttttgatttcctctttgacacaatagttgttcaaaagtgtggtgtgtagtttctatgtatttgtgaattttcctgttttcttaagttattgatttctagtttcattccattatggtgggaaaagatacttaggacgatttacatcttcttaagtttgttgatacttctttgtgattatatagcctaaagaatattctgtgtacacttgggaagaattctattcttctgttatttggcaaaaagttttgtatatgcgtattaggtccattgggttcatagtgttgttcagttctgttgtttgcttattgatttctgactggatgatttatccattacagagaatgatgtattgaagttacttgctattattattattattttgagatggagtctcgctctgtcgcccaggctggagtatagtggcgcgacctcggctcactgcaacctccgcttcctgggttcaagcaattctcctgcctcagcctcccaagtagctgggattacaggcatgcaccatcacgcccagctaatttttgtatttttagtagagacggagtttcaccatgttggccaggctggtttcgaactcctgacctcaggtgatccacccacctcagcctcccaaagtgctgggattacaggtgtgagccactgtgcccgtcctacttgctattattttattactgtcaatgtttgccttcagatctgttgttgctttatatatttaggtgctttgatgttgggcacatatatatttataattgttacatctttctgttgtattgacccttttatcattatataatgacttttgttccctcttgtgatgatttctgacttaaagtttattttgtctgataaaagtttagccactcatgttctcttccggttacttacttgcatggaatacctttctctacccttttactttcagcttatgtgtgtctttaaatctaaagtgagtcttttgtagacagcatgtagttgggtcttgttttcatccattcactcatactatatcttttgatttgagagttaaagtaatgattgataggtaaggacttactattaccattttgttggttgctttctgttttgtggttctactattcctctctttttctctttgtgatttgatttttatttttgtagtggggtattttggttctttttatcttttgtgtatctactgtgcttttttgttcatcgggtttgcatcaaacattttatagttatagcactctgtcttacgctgagaagaaattactttcaatgacgtatagaaactctacactttagtccccattcacacacctaatgtaattaatttcaggttttactttatttttgagacagggtcttgctctgtcacctaggctggagtgcagtggtgcgatcttggctcactgcagcctctgcctcccgggttcaagtgattctcctacctcagcctcctgagtagctgggactacaggcacacaccaccacacctggctaattttttatatttttagtagagatggggtttcaccatgttggccaggctggtctctaactcctggcctcaagtgatctgccttcctcagcttcccagagtgctgggattacaggcacgagccactgtggccagctgcatcttttagtttctacttgaacttcctttagttgctctcataaggctggtgtagtcatgacaaactccagtttttgtttgtctggaaaagtctttatctctccttcattcttaaagggcaattttgatgagtaaagtattcctggttggcaggtttttttttctttcttttagtactttgaatatattatctcccgctttcctggcctgcaaggtttcagctgagaaattcactgatagtcttatagaagcttccttgtatattatatgacaagtaggttttctcttgctgctttcagattttttctttttgagttttaacaacttaattataatgagtcttggtgtttaacttatttggagacctttgggcttcatgaattgaaatgtcccttttcctccctagatttgttaaactgttagcctttagtttttaaaaataagaagctttctgcccctttttcttctccttaactcccatatgcctgtattattttcacttgatgttgtcccataagtcctgtatactttccacattcttttttattcttttttctttttgtccctctaatgctatcatttcaaatgacctgtcttttaagtttcccagttcttttcttctgcctgagtctgctgttgaagctgtctcttgagcttttcagttgagtcattgtattcttcagctccaggatttctatttgcttcttttttatggtttctgtttctttattaaacatctctctttattcatttatttgctttcctgattttgtttagttgtagttcattgagcttctttaagatgattattttggattctttgtcatgcaattcatacatctctatttatttagggccagttactagaggtttattagtttcctttggtggtgtcatttttgcctggttctttataattcatatagccttgcaatggagtctatgcatttgaaggagcaggggccttccagtttttatggactcgttcgccaagtaaataccttctcctattgagtccctgggttgatgggattgcctgtggtattgtgattaagcagggctgaagctagattatggggctacattagggttcacagtcagtgggcgtaccactaggggcatggacaagtatgtcccatggatggggagagctgtctctggaactcaatagggtgggacccaagctgggtcccaggctggtttgggtttatgtttgggtccaatcagcagcccttttaccagaggaatggacaggcatgatttccacaaggcccctgttaaggcaggacttcctcttggccacagtagagcagggctggagccaggtcagagtgctgctttgagtctgcagttgggtctggttggtggatctgttactaggggcatcaacagacatggttccttcccaggatggatgaggctggtggtaggactgcagacaagtgggactggagccgggtttacaagggacaggctgattctgggtctgtagctgaaaggtcagtgggcctgccttctccaagcagcccttcctagtcttgggctccaccaaggtttcataaccacctacctcaatcctaaggttcttacaatggcacttatggccatggatggcttccaaactattgtttctgtaggaggaccagggctggggacattctcttttgctatcttgcttacgtcacctacaacctactttaaaagtaaatttgttctaatgagcataatgagaaacaaagattttaaaaataaactaaataattaatgcctaagtaattccaggttaattttgtatactccagttcttcctatcaggtatttgtcattcagagaggtaatagtatgaaaagaatattttaggagtatatgagaatattgtatctttttttagaatatggttggctaaaatatttacatctgctcctaaaatattcctgcataagcttgcagtgagccgagattgcaccactgcactccagcctgggcgacagagcaagactccgtctcaaaaaaaaaaacaaacctatatatatacatatatatgtatatatgtattcctgcataatattatcttggtgtttatattacctgtgaagctgtaagtatattcttttatttctgtaacaatttgacaattgaagaaaagtatgtgttgaatttttagcatctactacacacacacgcacacacacacacacacacacactactgttgtactttgtaatatcaagacactgataaaagttttggtgttgtattgttatggattaagacaaaaaaattaaaagatgagatggaggagctctttctattgtaggattatctattgttttcatgtttgatctgtagtgaagtatattagtgaaatagagaaacagaatgatgagtactaagctattcataaaatttcagtagtgtgtaatacttgtagttttgaaacaaaatcagctaatatcaccttgacttttccccatcttcctattaaaaaaaattgttttaattctggatttatgttttctaattttcttttccagttaccctgcagtttgtgaatttttgcagaacaataatttactatcaattatcagagcccatgaagcccaagatgctgggtaagttacattaaaattgtaccaaatatcgctgcagagtctttgcatttaatatgcagacagatggactttcatctctttttcaggtatcgaatgtacaggaagagccaagccacaggctttccatcacttattacaattttctctgcccccaattacctagatgtctataacaataaaggtaaaggaatccagcaatatttgagtttgaatttatgagtaaacgtgagctctggtttaattgtatgtacgtatgtgtgtttgtgtcattttaaaacataaattttaaataagaaaaaaaggggtcttagttgaaacaaaggccaagaaatttagaatttatgctgctgcttggtctttatctcctaaggattactggcttctttgtgagtataaataatgatcataataggtcagattgatactacagaatcaaagtataagaagaataaattgcttcaggctcatgccagaatagttagcataaattattggttttggtgaatttaatgtgtttataacagtatctcaaagtcaccattggtattttaatctttgtgaattattaaactatttttgtttttcttgagatatggtctaggtagagtgacctagtgtacaaagtcaaaaaaaaaccttcatttttagtttaaaccctgccagaaacgaatactgtgactttgagtgagtcacattatctttctaatcttcagtttcccatatgaaaaaagaagaatggatatatacatgccttttgttccagaaattttacttctaagactttatcctgttaaagtcttttttttaatttaaaacttttatgattaatagtttataagttttctatcgaggcagtggtcctactaaaaacttcatatttctgtaactattttgttgtttataaagtatgactataaattaataggactttgaaaataaacatgccagaacaaacatatccaaatgagtattgtcccttcaaagtagttaccttgggaggctacacacctattccaacaatgctgtccttgttcaaaaacatttttggaactcctcttttggcattgccttcagagtctgcgacacattcttttgattatcctcaatgatgggaaatcttcgtcctttgagggtggatttgatttttggacagccaaaagtcattcggagtcaagactgataaataaggtgagtgatcaagctagatgataccatttggggtcagaaacaaggtatgattataaggtaatgagactggtttttctcgtgttgctgatacagtggctctggaggcacttccaaaagaggagttccaaaaacgttttgagtaatggcagcatctctggattaattatatggtaaggcaacaagttgtgctgaaaagaacacaaagcaaggagtcagtctagtcctgcttcacttttaagtgtgtcacatttaacaagatacttctctgagcctcatctttaaaatatctgtcatatggggttgttgaagataagttggaataaggaaaatggatattaaagtgttgttcaaaatataaattactataataatacagattttactgttattgtacctgatgtgataatatcaaaggaccacactcatctgataaaaaggtctggtgtgtttgtagctggtggtttcttaagtctcattactttatagttataccttgtatatgcagttggggagataagtttcaaagatggccaaaatataattaatatttactctatttaaaagtaaaccatggaatggcacatctcatttaaatccgatttgggtcagtcattttagtgtgtcctccagtgacttgtctattttaaaaagcatgtctttaacttaagttctgtcctagtcttatgttttcatttaacttagcattcttctctgagccttatctgtcctacaatgctctgcttctccctaagttcatttgttatttcctttttcctgatatttccagtatattagcaacttaggttttattcttatttattctcttatcaatggtgtggactgtttgtgttgttaaacgtcttcaaggactcttgtggccctagatctcctatttgtaatgaaggtgtttctttctcactttcttttttaacttcatcaaaaagagtatctattgattgctcaatggatttatcagtgtgccaagctgaaacacgccacctaagtcagcaggcactatacagctcactcactgctagcttgttttttgtctcaatctaacctggttttgttcttgattatttctttagcaaacttttaacatcacagtcctggccaggcacagtggctcatgcctgtaatctcagcactttgggaggccaaggggaggatcacttgaggcctagaattcaagaccagcctgggcagcaaaatgtgaccccatctttacaaagaaaaatttaaaagttagccaggcaaggtggagcatgcctatagtcctagctactcaggaggctgaggcagtaggatcctttgagtccagtagttcgaggctgcagtgagctgtgatcacaccactgcattccagccaggcaatagagcaagaccctgtctaaaaaataaaaaaaaaagtaaaagccacagttcattctacctgagtattctgtcggctttgacataattagtaacttttatctcaaaacagtcttattttcattggttgtttcttaagcattttagaaggaaaaaggcagaaaatgtggcatttgaaacagtccctgggggtactcagttactccccatacaagtgccttcttttctgaaaaagggaactctattattctttttcttcttccttttcttctactgttgctcttctttctctttctctcttttcttttctctctctttctctctctctttcttttctttctttttctttctgcttccttttcttctttctttctttctttctttctttctttctttctttctttctctctctctctctttctttctctctctctctctttctctcggtctctgtcacttaggttggagcacagtggcaggaacttgattcactgcagcctcgacttcctgggctcaagtgatcctcccacctcagcctcccaactagctgggaccacaggtgcatgccgctacacctggctaattttaaaatattttttatagagatagggtctcgttatgttgcccagactggtctcaaactcctgagcttaagcagtcctcctgcctcggcctcccaaagtgctggtattacaagtgtgtgccaccacacctggcctctttcatattattttttttttttcagagacagagtctcactgtgttgcccaggctggagtgcagtggtgcggtcttggctcactacaacctctgcctcccgggttcaagcaattctcccgcctcagcctcccgagtagctgggactacaggtgcacgtcgccacgcctggctaattttttttattttagtagagacggggttttaccatgttgcccaggctggtctcaatctcctgagctcaggcaatctgcccacctcggcctcccaaagtgctaggagtgctctttcatattctttagacttcttggtatctacaggtatttcctagttccactagttacacgaaagacctttaatcatgatttttaaagattcttattcttgttttcttctgtccactgggaacacacccaaaagcagttttataagctcttgtttccagtcattcactgttgagactcacctcccacttctttttcctgggtagaaattgagggagttgttgaataatgatatatgacatatttacctaaactaaataaaatacatacacgtgaaaataatggaacatgtacatcatagccagtgttaggctttttaagtgctagaaactatattttaatttattttcttaataatatatggtgtacattttagacattcaataacttaaattttaagaacactagattatcctgtagcaaagaaacaggaatgaggacgtgacctatatctgtcatttctggagaactgttacaccctgttttattttatgaccacagaataattaagagaatagtgcaaacaacattgctggtgataaaggctaaggaattggattttaagactttcaaaatataaagaaaatcagtttggcatcaaagtatgtgtgcgactatctgaatggttaatattaaacatagcatgctggcaatacactgctgtgtattggagaaatcggcaattttaaaatccgctatattgaatacagagatgacttaatctaattttgaacatttaattgtaaattgctccaagtttgccatttgtatcttccagtatgagttgataactgcaatatataaactcccagagagtgtatacaatctttgactctggctaatgactagcaaaacaggctgtgtccatttaatgagtaatttttgccttcaaaggagagttgtaattataaccatttggcctataaaaggaaattatggggaaattttcctcacgtggatcttgaggtttatatagatagttactgtgcagtgactccaaagtttcagtttcttttgtacttttattatatgagctcttcaggtaactttgttccttggaataattcttaagagaatgaactgaataaaaggctttaaaattttccatctgccctttacctagtcaagtcctgactttacaaatggaaagttctcgaattctgtgtagcaggtacacagctgtacaaagcataccacttgccatgccatgttcctctgtgccagattttcttgcttttttcctttttagctgctgtgttgaaatatgaaaacaatgtcatgaatatcaggcagtttaactgttctccacacccctactggcttccaaactttatggatgttttcacatggtctttgccttttgttggggaaaaaggtaagagaactaaagcacatgtctcatcagttgtttggtgactgagcataccttatatttgcatgagcccctccatgattcagaaatgttttctaattttgtttgttctctacatagattttttttttttttttctgagatggagtctcgctctgtcacccaggctggagtgcagtggcacgatctcagctaactacaacctccgcctcccaggttcaagcaattctc

SEQ ID NO: 1587 - DNA, 2134 bp, Homo sapiens
gggccacccttagcagcggtcgcggtcggtgccgaagcggtgttccccgccttagccgctgcgcctcccaagagagcggccggtgggccctcgtcctgtcagtggcgtcggaggccggcctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccatcagagggttctcgcttcagcacaagatccggagttttgaagaagcgcgaggtctggaccgaattaatgagcgaatgccaccccgaaaggatagcatataccctggtgggccaatgaaatctgtaacctcagcacactcacatgctgcgcacaggagcgaccaagggaagaaagcccattcatgacttagagtcctgccgtgctcaggtggatctaaaactcaagaacaaattctatttatttattattggaaaatgaaaagcaactcaaaacaacttcaacctggaggtgcatttataattcagtctgcatttattctgtaaaaaggtgactgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaacctgggtttctgacccc

SEQ ID NO: 1588 - DNA, 1509 bp, Homo sapiens
atgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccatcagagggttctcgcttcagcacaagatccggagttttgaagaagcgcgaggtctggaccgaattaatgagcgaatgccaccccgaaaggatagcatataccctggtgggccaatgaaatctgtaacctcagcacactcacatgctgcgcacaggagcgaccaagggaagaaagcccattcatga

SEQ ID NO: 1589 - DNA, 78028 bp, Mus musculus
tgataggagaaagggtctgttggttaccatgtggcatggccattgtatctgtaagagaaggatactgtagcccctccctagaacagccatccctccagtatgccagtcttctcctggttcactgcacaatagctttctgactttaccctttgccatcttcctgtctctttattttgtttgaaaaatacttatttttatgtattctttgaaagttccatacatgtatacattatgtttgagcatatccacccaacatcacatctctccaatgcccctacaacaccccactctgtctgcacccaactttgttgttgttattagtcctgcattcaggtcaattagtgttgcccatatggacgtggtatgtgacatcatcatacattttggtgtggggactctaccatcagcatgtggctagagattgtccctctttcggcagccatcaattgccagtagcttactcaccaaggtggcattttgacaggcttgttctcatctagatcttgtacaggcaaccacggctactgtgagatgacacattgcctcatttttaaagatagaatcgtacactatagccaaggctagcctaaaacttactgtgtgtgtatgtgtgtgtgtgtgtatacactcatatagctagacttgaactatcaacaattggatcttacactatagatgaggctggcctagaacgtactacatattgcaggctgagcttgaactatcaactatcctctagtctcagcctcccaagtgctggcattacacacatgagccgtcatgactagcttcccttcgttcttagcacatcccatgagggagcatcttaaagggcccttgacccttgcacacctcattagatacctcatttgtttccctgagtataatgaggtcttaagttgaacctggacatgtggtccaaaacgcttattaaatcagattactttctcacactattagacaaggaaatctgtgcagacaaattttgtgtctatgatatgaagaatgtccacctgcaggagacattagcagtgtgactattgattgtgaagtagttcgcctaagaacagagggcagcagacacaggaagcagcaaggaagggaacaagagcagacaaagaatgaaagcaaagatgccctttctccagtcctcccgccctcgagccccttgtttgagcagcttttgagaagggttgttttttgttgtttcttcttctctttgtttttgttttgttttgttttgttttcatagactcttgcctgctgaggaccaggctaatcatacactactatgccaggaggttttttgttttgttgttgttttgggttggattttgtttgtttgtttggttggttggttatttttgtttgcttgttttggtttctttgtttttgtttgtttgtttttgtcacctttgaggtttctctttaagcagcctgctgaagatcagctctagagtcttcagctctagagtctcctggacagctctgttctcatcggaggacctggttgaagacagcatcagagatgctgttacaaccagcactgaagctaacaatgaagaggagcagtggcgagtgagagacacccagaactagacaattctgtgcagccttcaacagtccactccctgggcaccagttcccctacttggaaatgagagggatgagggctctatctgtctgggttttaacagtagaatggtggatatgttcaaagcaggtggaactatctggcagtgttttcacctctgtggggctcagcctgtgtttctgattctctccttgggaatggcagttaagtggcaacttggtaacactactgctctgggatggtccctgctctgggatggcccttgctagatctctgtggttgtggttggtgatgtgggaggcaggaggaagtggatggagacaagctgaccattggtttgaaggtccaagcttttaatccccttccctacctgtgaggagagccaggccaaactgaccaggccttgatagccattccccagccagccgtgccctccctggttgacatcatctttttctcctctctagcccatagaagccaacgcagcttccagccaccattcgtgcgtatgaccttgcaccctgacttcatttactgaagatatgcagagtcaccatcaggaataaggagaatttggggtctgaggaaaatcatcccaagcttgggtggggtaaaaataccctgtggattgaaccctaaaaaagttcctcaaaaatgacatgacgtttttctgccaattaaacttccctaaccgcttcctagaaaaggcagaaattcagagaagttgtaaggcaccagaggccgaccagatcactagattctcccctttcagccttggaaaaatcatccactttattaagggcatctttaagacccatggacaggaaaagcctccagacatttgcctacccatgaactggccatcagccgacagggtttcccacagctgcaccctgagctagtgcagcagccacagccttccctgtgccatcctacctgctgccaagtcagtctgcagacacacagcctggcaggatggactggtcagaggttcaaagttgcttgtgcagagtgtttccagctgccattgatttgttaggcgccgtgtcagaagcaagtcaaatggtcgtgacttgtagtagtagattaaataaattgtggtgttcccagacaggaaaacctctgtcagtctcaaaatacttatagggactgtattaactcacagggatctatgtccacaatgtatttgctattggttccctaaagtgccttttaacataatggtacttagaagggcatctctacagatatgtccggataggcacagagtgcctgccaactatgcctgccaaaagccagagagcaattatctggaggtttactctttactgtcttctttataatatactctttttgtatcttaaaatattttttacaatgatacattgtttcattttgtgccaggggtgggggtggggagctatactttcagttttaaaatttgagttaagtcaatgagctaaatcactcatatttgagagatgtgacctgggttggttgccctataagactaaaagccacatagaggacttcttgtgtgccagccaacggtgtctgaggaccttctgggatcaacttgcgttacctgtacagtagctccaggaagcaagtcttttatgatccacatttgacagatgatcaaatggggaattagagaagtcatttgtctaacatctctggctgacaaggggtgaaacagagctctatctggtcaaaggcctgcttccaaagcaacggccaccatgccgtatctttggcttacagcatcaattcaccggttctgcatgcatggggcacggaagggaccgagagctgagcaggagctagggtcacggggtcacgggtggggagaaggcagaagtgaaggctgtggattcaaacagatgaccctgcgggttcttggggtcttgtgggcctcctgttccctcggttccccccacttgtgcttcctccgtcgttaacagggcatcgtttcaggcactccatttagaattaattagttgctatggctacctacctagtagtgagtcatgtggtaccacttcactgccctactgtgtccactaacaccttgttccaggccaagatgtagggagaagagggattcctatgtgagggaagttctgagtgaatgtgtgtttcattatgggcatagcctgtcaaggactccaagaccaactggcccatgggaaactggcaaggctttcctcgggagtctaggtatgagtgtttatgacgagaggtcagtgtgtgcagggattagtaactgcagcttcttcctcctagacgtttacagcctgaggctagtcatctgcagagaccttctaccagactagccagcacctcccctgtgctgtaccttataaaggttgcaggtactggccatagtggtggattagagaaccccgcctgatcccagcttcacagtacacatatgtactttcttcattccctgggtgcccttagtcagagttctgcgacccaagctgagcccatcacccccacactgagacacacagaccccagggtctctgggtagggaagctgtcccagaaggctggaaggtacacaagcgtcctcatctctcaccaccctgtggcaacgctgttcatttgtcattgtctattgggcataagcccctgaggctgacacagttgccttgtggaggcctgtatccccagccttggaagagaacactcagtaagagaacatcctctgttgataattggaagttattcacaagaggccttgcaattaaagtggcatttgtgaattagctcgtaagatttaaaaaaaattttttttctgttttctacttacctggctcagagttctgacaccaagaagttgctggtttttaatatgtaccttaaaccagaggggccagtagtaggccctattttatactagatactcgagtgaagaacttctaggtgttctatgtacattataggctataattcacaaagccctgtgttggaggccagggctctgaacagtcaggccacacagctagagaggggtgaagactggcttctgtctggagctgtccacactaatttccaccctgctccctcctcttgagttgttatagctttgaagaacaggcctgttcttaactctgccgcctacacccatgagagagcaatttaaatttaaacggcattctcctcttctattgctggattggagactaccacattctttctttctccatctgctgctacttcagtctttcaactagaggagatgggtgaaggaaggggagagagagagagagagagagagagagagagagagagagagagagagagagaactgcaatcagagtgtggcctgtactgcaatcaaattgcaaacattttcatccaaaaatggagccaggtgccttttaactgcctcccccagtgctctccgacactaagctgtagtccggtatcctctgtctctgtgtgagtttgtcgactccggatgcttcatagatacgggattatataacgcatggcttagtgcctggcattgtgaccatagaatgctttcaaggtgcattgacatctcacggtatcatatcatcacatcatatgccgctgtgccacttatcctgaggactcaattatattccatcatacggagtactgtgctttatgcagtgctgtttgtggtactgtttgtgggtacttaggttgtttccacttttggactatggtgaataatgctgccatgaacactgacgtagactgtgtgtggatatacattttcacttctcttgtcatgtgtacattgctatgcctagaatcttaggtcatactggaggcctgtgctatggtctgaggacctgacacagtcagttccagctaaaattccaatcctgtatctattcaactcatgccttctcccaaagcaagctaagctcctggctttcccgcctcagagcagaaaagagacgtggccaccttagcttggttccaactgcaatcagtagccttagaatcctgtcttcctatgccacaggcgtccagcctttctgcatctccgtgatccagacctgggagcaaaggtagtcccatttccttcatccttatgaacaccaccatctcccattacacgcatgcgcagggtggtaaacttcccacctttagaaactccatgcaccaaacctttgtaatgcatccagtgtcaatgcatccagcatcctgtgtccagaatcctgtgtcatgtgtccaatgtcctgcgtccagcaatcctttcttctgtccaggaagagggggaaagaggatgacacatgtcttctctaggcttctagaaacttctacctgtcacataaatccactcctctatttttcattgttgaagtccaggagtcaaatgcctgacttcgtgcttgacctctgacaaccccttcacccccaacccccccacccccgctctgaagaggcctttctgggggaaggagatctgacttaaatttgacaattttgagttcagtaacttgccttttggccaggagtcagagccttagttattctctgttcacggtgcagaggggtgaagttggagtggcaagtacttcataaagccccaccctttgcttttagagctcttgtctgtgaatgagctaaaacctctacttgggtcctgaaatgaacatctcagctgctttggacagagcttcagtctacccttccccccacctccctccttcagtggggatcctgatggaattccaagcttctctgtatcctgaaacagaccggcctccagttcctgggctgtaatacaaggggccagtttccaggcagatttccctgtccccagctgtgtatgtccttctttctacccacaagtccctatgctccagaggaggctagccattactcccttctatcaggttccagataagcccatacctgaatcttggttgtagactttgggaaaggtgagaggacctgttctaaagcagctgcaggcttctcttaggtctcaagccttccccagcccctgccctttgttatttctccaaagccagtccagtcagagtaggcacaacacaacagtcaccacagtgcatttagaagaaaatgtcttagggagagacagaaatgggcgtgacatagcctctctttactctgtctctgttcataatggaagcccttggtaattttgtacacttaatgagatcattattatgcatattataatagtatgttttctgacctaatttgttgttttccattaccaatatatatacaatgttagaaggatctactgtcctctctgtctctctgtttctgtctgtctgtctgtctgtctgtctcgctccctccctccttgtcagagacctttgggaacaaagaaagagcttatgagtgtttataatgtaagagatttcacagttatttgtagtttaataaataaagacataggagccctttgctaagttcttaaaatgttttctcggttttgtttgatatctaaccataatctccattactcttcttttaaaagttacttctatagatttaaaagagtaatatgggttcatagcaggcagaaaatgcaatataaggtggaaaaaaagagcaactgcataccaaccacaaagccaccttcttgtcccccatcccgagaaacactctgtggagagttctgtagctgcccctctggcattttttttctctttagatacatagctttccaagcaggccagcatgcagagacggcagcttgagttgctttggctgtgttgtaaagacacttgggctttccttgtttcaaactagtccaggaaaggctggtgggtgagcagccactggagcaaattcaggcctaaagagtggttcttctccatgcttcgctcctggagggtgggctgaggatcccacagatgctaaaatcccagagccacacagagactgcatctcagagccacgagtgggaggaggtctgcagaggaaggcctgaagacctcttcccagacagagtcacccttatgagccctccttttttgtagtcgaggcaaacactcctttttgcaatcattacttcttgctcaagtgagagagtaaaataatatatatttttaaacattttaaaagcaagcaaacaagtatagaagaagggccctgcaaaccaggagtcagagagtcagggaggcaaaagcagagagcaagaaaagccaagacctaaatctctcacatcccctacctctcctgcccctgagggttcaagaagtcttaccctccgcatctgcacttactgtagcctttattttaatcaccttgtttgaattttgccctgctcagcttcatgaaatggtggggccacatgggcctgagttccaatttagccatgcagctaagaaaccactgctatatcttgtgctgtatgttagccattccttcttgtgtagactgactttctagattagaagtgaaaatgagataagatactgcagggaattagtgccaggtcatgcccacctagatgctgtagtaaactaatgcccacccccaccctctcaccccaaaccctagtcatagtctagacccagaacttctgaatttacttggaaactaacaatttatagatacaattataattgatcaggctggacacaaatgcaatggctgatgcctttatagagataggaaagggacagagatatatgtacaagggatggggccatgtaaaaatggggtggtgctctacaaagcaagggatgcccaagactgccatgtagctacctggtgggaagccatggagaagttgggaagtgttcttgttgtatttattttctctatttctctgtgtgtgtgtgcatgtgggcatacctttgtgtgatgcacttgtgagtgtgaatatggagacccgagggtaatgtcagagaatcatattccaccttattcaatgaggccaggtctctcagtcagacccggagcttgtgataatggctagtctcattagccagcttgctgtggggaatccctggtacatgtggaccaggggtacagctaaagggcagctgacaagaacaatggctctagggtgcctggcaggtaagcggcttgagagagcctaaagataaaacagaactgttgaaaacaaaaccaaagtatgcttccaggcagcatgctccagttcctcagaaaccattctggtttgaatgacaccccacacccccgctttttctttttaacaggaaaacagcttcaaggatcgtgaccacatcatttttgttccctttgttggatatatcctaatgtcaaatgtggcatatctttgttgtctccttctgtctcccaactagagagaacacacttacggctcctgtcccgggcaggtttggttgtcggtgtgattggcttccagggaacctgatacaaggagcaactgtgtgctgccttttctgtgtctttgcttgaggagctgtgctgggtgctgatgtgagtatgaagtacattgggaacttctcttactttctgggtttgtgttgttgagatgggtgagtctgttgtgctgggggaacactttttaaaaatcctactctgagaaattgtgcttacaatgaaatcattcctaccttccaaagaccaggtgtttcagtgttttttattcttttttttattaggtattttcctcgtttacattttcaatgctatgcccaaaagtcccccatacccaccccccccaatcccctacccacccactccccctttttggccctggggttcccctgtactggggcatataaagtttgcaagtccaatgggcctctctttgcaggatggccgacaaggccatcttttgatacatatgcagctagagacaagagctccggggtactggttagttcatattgttgttccacctatggggttgcagttccctttagctccttgggtaatttctctagctcctccattgggggctgtgtgacccatccaatagctgactgtgatcatccacttctgtgtttgctaggccctggcatagtctcacaagagacagctatatctgggtcctttcagcaaaatcttgctagtgtatacaatggtgtcagcgtttggaagctgattatgggatggatccctgcatatggcaatcactagatggtccatccttttgtcacagctccaaattttgtctctgtaactccttccatgggtgttttgttcccatttctaagaaggggcaaagtgttcacactttggtcttcgttcttcttgaatttcatgcgtttagcaaattgtatcttatatcttgggtatcctaggttttgggctaatatccacttatcagcgagtacatattgtgtgagttcctttgtgattgggttacctcactcaggatgatgtcctccaggtccatccatttgcctaggaatttcataaattcattctttttaatagctgagtagtattccattgtgtaaatgtatcacattttctgtatccattcctctgttgaggggcatctggattctttccagcttctggctattataaataaggctgctatgaacatagtggagcatgtgtccttaccggttgggacatcttctggatatatgcccaggagaggtattgcgggatcctccagtagtactatgtccaattttctgaggaaccgccagactgatttccagagtggttgtacaagcttgcaatcccaccaacaatggaggagtgttcctctttctccacatcctcgccagcatctgctgtcacctgaatttttgatcttagccattctgactggagtgaagtggaatctcagggttgttttttattcttaatgagcgtcttcatgaggtaaagaactttctgcattaaaaaaaagtttcactatagagaaaactattcttgtttggggcttaaatttgtttttattaatattgtacagtggtggtggtggtgtgtgccatagcacatgtgttgacctcaaaggacaactttgtggaattgggtctgtctttctgcctgtactttgtagggatggaacttagacttggaaggccttgacccttaccaccaagccatctcaacagcctgaggggggaaaaaacattcttaacattgcctccctctgagttttgaagttaacagtttaataactttgaaactctacttttctacatctgacatctgtgtgtggttatccttttggacagcagccaatattcccatctggcctgtgtttacaaagcaagactctgagagtacactattagagaaagaaagaaacatgtttaaatgataatattccatggttctaaacaattttttatttttcttcatttttaaaaaaattttaaaattataatataattacatcatttcccccccccttccccaaaatcctgtacatcttctgcctcgctctctttcaaatttgaggcatttttttcattagctatggttatatatatttctaaatacaacctgctgtgtgtgtgtatagttttactcatgtgtacgttttccgagctggccatttggtattggataaccagttggcacagtcccagctttccgtagttgcgtatagttcatggtgtagggatgaagccctgagggttttctcctttctcctttgtctcttgttattgtctttcttcagctcacattttggcagttatgctactgagactttatgggtgtaaattctgacattactaggaaatacagtctcacagcaaacaccctggtcatctggcttttgtgatctttctgctccattttctccccttccaagtatgagggcccattaacaatgaacattgctcttgcaatggaaaacttgctctacttacctttattacctgagctcttttcatcaacagactctcttccttgtctgatgcttctgagtgtcttctcttctgtctccatctgcaagtcattccattggcttggaatgcttgaagattctctgagccctgagtgcactggatagtgcctggctgcagtagccattcttgtttgtcaacttgactcccatctggcgttaactaaaaccttaaaatggagggatttttgcttactttgaagtgggaagatctacttctaatctggatctttgaggtaggaagacacacctttaatccagattttaattctcatcaaacctgggccatgccttctcttctattagaagcctatacaagacatgaagaagaaagcttttgctctttgcctgcttgctctcacctctactggcaacctatataaggacatggaagaaggaagttttcctagcaattctatttcttcactagcattagggcctacttcttcagaattccaaggtgtactgaaaaccatctaagtcaaccagcgttgtgaactcatagattctttggacattccatttttatccagacattgttggattatctggatcacaacctgcctgcaagccatatatatatatatggagagagagggagggagagagagaaagagagggagagagagaaagagagggagagagagaaagagagggagagagagagagaaatattcattttctaagttctgttactttagagaacattgactaatacattggccatgaccacaaggatgcattgaatgctgttatattactgttttaatattttttttcagtaaaatggtaggcataccaccagaaataaagtggaatataaaacaagaagtttgattctgatttgaaaagaagatactggaaatgtccccagatattactgaggtaccacaaactgaggtaccacgctttagagttgattagccttacaagatagtttcagtgtgttcttttactaagacagtatcttcagtccccaatattagctaacacttccacggtggaaccgacatctttgtctagccctaaaaccttctgaccttaaagcctcagtcatccttgatgcttctctttttctcacctatatggctgatcagttgccaattgtttcttcaagtgtcctgtgaatggtcttactgtctctcctttctctctcttgcttcccctttctgactctaaacaaagatttatgatgaaacatctagaagacattgattcactgagtggtaaacctccattataccccttctccagttacacacacacacggacacacacacacactgacacacacacacactgacacacatactgacacacacacacacactgacacacatactgacacacacacacactggcacacacacatacactgacacacacacacactgacacacatactgacacacacacacactgacacacacacacacactgacacacatactgacacacacacacacacacacacactgacacacacacacacatactgacacacacacatacactgacacacacacacaatgacacacacactgacacacacacttatacacacttacacacacacacttttcacactgttttggcattttaactgttttgggatgaagggcactgcaacctcattatccctctgcctggcactaagcacattgttgtttgaatttgaatttcagaaaccactttgtctgttggcactgccccttcagctttcccatgcctttgcatttctgaggctttttatctgagcctctcaggtgcctactcaaagaactttcaggtcaaatgtctcagagctataaaagccactttaagtcccccatccctaggaagtctccatatctgtagtcagttcacatgatgctggctctcttaacactcatgttacaccagcttctacctgagtggggtttttgaccttctaacttattataatgtctttagcttgcacgggtcttttcctaagtggatcctcttacaagttctccacagtctgatagaaagactcaaaaaagccagtatgtatattggaggagcttggtgtttatgggatggacagttgagatgtagtttgaacttaagtattccatcccattaatagagatgaatacaaatttaataagttgtctgttgtaataatataatatctgtcaccacagatgatgggcagatataaagtcatgcaatttctaaacctaagactgtctgttacctcagaagtgataatggcagtcaatgtgaagaataattgatcatttacaatgtatcatccaagcacccacaagcacttctgtacacctccagactcccccatcactccatacaccccagactccccatcactccatacatcccagactccccagaccctgcttgcctagctacaaagcagtctgttcttccttctattcactgtacttgacttttgctttcctaactataagggctctaagtacatattcgtttagaggaaaaaaaattggttctcactaagaactccaaggacaaaggtcatatttgcattgcaaagagttttgagacaagtttatgatggaggagcttaaggtatctgtgctggcaagcttgcaagcattgaaaaggaatcactctccaccaatggaaactcttgcttccaagtgggcctttgtcttaagtaagtcttaggataatgattgtctactttgtgactagctcatcctgttgtggccttaacttataggaagttctttctcaagtttctttttatctaaaagaaaaggaatccaacggggagccagactcatgggtaaaaaattgtgcgtgtcatttattatctatctaacaaacttctgagaccttacatgccagtaatgagctgtaagtgatcattataggtgactaggatacactcaggatacaggaaaccacataaggcaactagaaaagggttgtaatgaatgtaaaagagtttaaggcttttaacaagacatatatgatgccatactaatctttaaaaacttacaaagaaactgaggtaaagttaacttacaaagaaactgagataaagttaaaaaaatttatttttacaaagtaaaatgagattagattttcgcaaccaccatgagttcctgttcatggaaagggcatgggtcattatgtgaccgagaggtaagagagaccagggcaggaaaagcattaaaggctgtcctaagaaaaacttgacttgaaaacaatagcacttgtgttttaaaataattaccctggctgctgtattgggaatcaaatgtcagataatgagattaggtagggtcttggaatcctactatcagaaaggtgcagaaatcaccacaggagatgataatgtcccagatggtacggaatctctggggtggtgagaagtgattaggctctgaagatcagtgaagagacagcctataggactagctgatgaatcagacgcagggtgagagaagagtgaagaatggttccaggattgatgctctctgcctcaacaaggctggtgtagagggagccacaaagggggagccagcagtgaggaagatgcactagggtagaatgagaagcaatgagaatcagaattatggtgatgccacaggaaagcagaagggacagggaccatctaagatgcacagtgggcgtagaagcaagagggtgggaggaaagtatggaatgactcctaatattctggcatgtggtggtggtggtggtagtagtagtagagtagtagtagtagtagtagtagtagtagtagtagtagtagtagtagtagtagtagtagtagtagagtagtccccttgggtggctaaagaagaagggaagctgagccagtggtgagtggcccaggtagcctattcatcactagaactctggctcttgtcaccctgtcactgtccaaaagtgagaacgttggcaagtgccaactactgtgcgtgaagacaataacttttcaagttatgcattttgtaaggaagacttacatggtccagacatgttgcaatcagtacctcaggtctgttgcttcccactttgttcttcccatctctcatccctgatgccatgcaggctgtggcctacgtgaccattaagcaggtccaatctctacctccagctttatactgtctgcccttccacatcttgaggaacttctctgggcactctagcaggcatttcagatctaatggatgttcctagccctctagtgtcctaatgactccatccctaagcccaggaggtctgtatttccttttaattacctatactgtcagcaatgtcctacaggtgtttttttgttttttttttgtttttgttgttgttttgttttgttttcaaaaacatagctctaagaaaatgggctagtctataacagatcaggctttattgctcacacacttcgctgggttctctcctcaaccttatctgaaataccggatgtggctgacatcctgtagttcagtaagtggagactgaagagcctagaaatgttaagagagaatctcttccttcaaaagaaacaagcaaacagacgggagtgggcagatggtgaggcaagtgccaccaacaggcagtgagcgctcagcaaacatcaccttctgaccttacttggttactctgtttagctttgtaaaatgtgaaggggttggacaaagtttaaaagactcggttctccctttcacagcggtaacaattggcaacaaagttctggctggctcggcttgcctctcacatccacaggtctgactggcaggaaagagaaagaacgtcctgctggtgagcgaagaagctggatttggaaagtggtgagacctggagtaaaatccaaggtcaccctctgtgtcctgcaggctgcagcgtgtcctataatcagagtgcctttttttttcaaattattttaattattagaatgtgtaactattagaatgtaaagcttttaagtatgcaaataaaaagtttaaaaccttggtatggtgagatagcctagtgagtctagattcttattgagccagcctggtgacctaagatctattcctaaacctcacacaacatgaaaggagagcaccaacttcataaagctagcttccagatgcataccatggcacttgctcctacacatggctttgttgccaataataataattttttttaatatttcagaatctgaaaaagaaaagaaaactgaaagactgcttttagagtttgaaagacaacattgttgagataattatggaactgctgagtcaatgtaattcctagcaaagcacaccagttccttttgtgcagaatagacaagtctaccctaaaattcatacagaaactcaagagagagaaattcaagggaaaggaggaggaagggccagagggagggggagagagaggacttcagaaggaacaaagctgacggccttacttcctaatttcaaacttttcacaaagctacagtaaacggcactatgtgatgggggcagagaacagacacagacctgagcaacatggatgcaaagtccaggaatacaccccacgtttatcatccaggatgctgggataattctacagagaaaggacagtttagttttttaaaataaatttattggagtatgtgcaaaagaaccttgctcatacacaaaaatgaactcaaaacagattagagacccagatatgaacagaacagacttagttcttatgagaaaatgttagcaagtaataaacacatttggcttattatacaatgcaatatcttcccattatgaaaggaataaagtattgatgtgtgctgcacaacagataaaccttacatcatgctcagtgcaagaagcaagccacaaaaggtcaagggctactcaatgtcatttctatgaaatgtcaacacaagcagttgaccaacacagatggacacctgccaggattctggaaaaaggaaggggaaatgggactatttctgagtgaatatggttccttcttttagtggtaattaagatttgccaaattaaatagtggtgttggttagccaactctatgcatatactaagcagtccaactgaatgaatagtgtgccaagagtttacattaagtttatacggcctgcttttgtgtgttaacaacattttaataaagctgctgaacatttaaaaataaatttaatgaacacatctttaaaaccctccacagatcacgccctccactagcccagcaccctagtgcaaatgtatacagtgccctcctaaggctgcgttgcagctcatccttccaaagcagtctactctctaaccaaagcaccgtcctctctaaaaatgcagacaaagtccccggggctccagagcgaagccctccaccggcttactggctctgctttcccgggcctgaggcgtgcagcttactctggctaataaagcctcaagacagaagggttgacagcagtgtgtcttcccagctggcttcaaacatgagcactctgtggatgcagaaaacctgaggtcagaagtgaaacaggagatggagccacactgagctagagcagggcctgccagtcatacctcctgtcccctagagcagggcctaccacacctcctgaccccggcagacctgagagctctcataaaacacagacacccacccaatcaaaatggctatcgtcaaggaaacatcaaaacaacagatattggcaaagatgcaggcaaaattaacccttgcacactgctgatgggagtgtaaattagtacagccactatggaaatcagcatggatattccttaataaaacaactaaaactggcaccaccatatgatccagctgttcccctcctccaagtatacccagtgaagtctacgtcagcttccaaatattcatatatccatgcttattgctctaccatttatagtaagcaagttatgttgctgacccaggtgctcactgatagataaatggaatatatatacatacatatgtatatatgcatatatgtatatatacatatatatgcatatacatatatatacatatatatgcatatacatatatatatatatatatgaatgatgatagaacattagtcagccataaggaagaattcaatgccatttatagaattgctaatgaggaagggggcaatgaggagatgggggaagtggcagatccagtaaatggactaaacataacccaaagtacattataaacatacctgaagagttacaatgaaatccattgtgtaagacaattaacagttagctgataaaagtctttataacgtggaggtaaacattttcagcatacagactctactaagcttctttgaggtatatcttagaacaagtaataaaaattaacctcaatttaatatgtccaaaagaataaaaagtgggtcagtcacggtgacacttgcctgtaatcctagtacttgaaagtggaagcaagatcaggagttcaaagtcagcctatgctatgtaacatagatagaggccagcctagacaatctgagaccctgcttcaaccccccctccaagaaataagtaatttgaaagctaataattagaaagctcattaagagacaaaccatacaacaggcacgttgggggtggcagcactcaacagcttcatgctttctgcttagtcaattaatacatattgatacaccagctctggtctcctgagccctgttctccgggatcacgctccgcgagttccagtccagctacagatgatggcttattattaggtaaacaagactgattttggtactgactgagctttagaaagtgacgtggaggcccgcaaggatacggatgattgccagtgtgggtggctgttgctgtccaccctgctctccagaaaaggccatgcgaggagcaagaagagcagctcatttgaattcagaaagagtgtcgtcttcctccttgctgtgcataataagctcttctccagaaaagcaacccgcagcctctcttcttgtctttgctcctccattgtcacttgcatctcccataagattggattctgagtcattaccctgctcttgggatgagttaaactctcagagactgaaaaagcgcgcgcggagccctgagactctcaattgtctgtttcagattgacacagaccatgctgctcctgctgccgatactgaacctgagcttacaacttcatcctgtagcaggtaggaacggaagatgggagggtcctggggacgatgagcaggtggtggctcctagccaaagccggaaatgagtatctgtgggcattcttttagagggagtgtggttactggatatttcaagtagcgaaaagaatactttccagggtattattgatccatctctccccactacccaatgcttgcaatgaattacatgtgtctgaacgaactaagaggccgcttcctttaatgtaaggtgccaagcagctacccttttgccctctatcagggacagtgactgaggcaaacatagagcacttcgttactcatgtgagttttttttaacaagcaatggcggcagccactggtcatttaataccataacgtagacttgaattggaaactcggagacaatagacccccaatgaaaactcagtcagaaggctatgcctttgaacttgatgggacataccgtggaggatgtggtttagaagggagaaagttgtttcagaattgattatttccctggggaaggcatttcagatcactggtgtgtgccatcagggctgcagtaccaagagaacattgggtttaaaaaaaaaaaaaaaaaaaaagcaacagttgtggggctaagggtgtggctgctccacagcaggagcgtgaggctttccttgaggggaatcatgggaaagtggtactttggcgttggatagccttttgataagtggctgtctcctctcccatctcattctgtccggggggtcagcccacgcttctcttccacgcttctcattctttccctgtgggctgcttaggaaatgaaggagctagggaaacagggatggcaagttttggttttgttgttttaatatttttgttttttgttgcgccgccccgccgcgccacccccccccccaacacacacacacacacacacacacacacacacacacacacacacacacacacacacactggcactctctgtaggggaaggactgtttcttttaagaaaagcagcactaggcaatcacagtctttatgagctctgacgtatgttgagggagcgggaaggatggtggaagcaaggtatgcttacattcacacaaggacggatatgtggcaatgtgcaaggcagcttatgtctcattcagtcttcacaacactcatttggcaaggagagaggctgagacatgggaaggtgtttcaatgtgcccgagatgacatagttagttactaggtggcatatgaaagattttcacacgctgatatcctttctgcccttcccctgcccctattatagtgctaacagtactaaataaattatgacagtagacaataaattgtgaatcgtctaactgggggtgggatttttacataagttttaaaatggagatatatatttttctgttttccaattagatattttctttatttatatttcaaattttgtctcctttcctctccaaaaacctctctatcccccccccccatgctaacccacccactccctgtcctgccattctcctacactggggcattgagccttcacaaggtcaagggcctctcttctcattgatgtcccacaaggctgtccctctgctacatatgcggctgaagccttgagtccctccttgtgcactcttggttggtggtttagtccctggcagctctgggggtactggttggttcataatgttgttcctcctatggggctgcaaaccccttcatttccttgggtcatttctctagcttctccattgggaactctgtgctcagtccaatggttggctatgagcctccactcccgtacttgtcaggcactggcagagcctctcaggagacagctatatcaggctcctgtcaccaagcacttgttggcatccacagtaatgtctgggtttgggaactgtatatgggatggatccccaggtgggacagtcactgactggcctttccttcagtttctgctccaaactttgtctctgtgtctcctcccatgggtattttgatcccccttctaagaaggactaaagtatccacactgtggtcttccttcttcttgagcttcatatgaatctgtgaattgtatcttgggtattctgaacttctgggctaatagccacttatcagtgagtgcatatcatgattgttcttttgtgattgagttacctcactcaggatgatattttctagttccatccatttgcctaagaacttcctgaatcaatcatttttaattgctgagtagtactccattgtgtaaatgtaccacattttcttgttcaaggacatctgggttctttccagcttctggctattataaataaggctgctatgaacatagtgaaacatgtgtccttattacatgttggagcatcttctgagtatatgcccaggagtggtatagctgggtctgcaggtagtactatctccaattttctgaggaactgccaaactgatttccataggggttgtaccagcttgcattcccacagcaatagaggagtgttccatatccttgccagcatctgctgtcacctgagtttttgatcttagccattctgactggtgtgaggtggaatctcagggtcatttgatttgcatttccctgatgactaaggatgttgcacatttctttaggtgcttctcagccattcggtattctggagatatgttctaatgtgtattctgagcatttcacaaaccaaaacatatgttatgagttgtgttgatgaattaataaaaagaaaacccaaacagcatgttttgctcgctcagtaaacttagaattcctgtctactctttctttgcaaaacatttttattaaaatgagtgttaaattagaacgcctccttgtgtgttttaaccgcatcgttatgtgtctttctaattaaggtattttgatttcttagaaagctattggtggggcacctagaaaacaaagcttaggaatgctggtggttattcaatggtgattgaaagggaaaaggcctgggatagggaggaaaagggaaactacagtatcattgtgtgtttgtttaggcttttaaatagaaactgcgcattcaggtattatttacaaaatacaaagtacaaaaatttaaagaatataggagagtttttaaaagatcctgagagtaggggggctatgatactcattgcctgagaggactccctggttatcacgggggcgggaatgatgaccccaattctgtaattgcttggtgtgtagcccttgacccgtatcttccctgaacaaaacagttcctacccaggagttatccggatatgattcctcattaccctctatgcataaatttctaggtttaaattttaaaaaatgcttagcggatcatttagtcgttacagacagacagtagcattcctaatgctctaaaatagagaaatcacggtccacggcaaggatatgttattataagcatggaagtaaatacacaaacaagctgctgcatccgtaaaacacccaggaggaaggatgacacacagcacaatgcctttttcctaagtctgctgttggagcatccctcaataattaggtgaagctgaaacaagcaagacatcgagaagcaccggcctcagtatcagttacctctggaagcagtagaggtgtcattagttatgctctagttcttggatgaggggtgggctcctggatgctcattttacttacaggaattgcgttaataactctcctataaatcaccctgctgtaagatatgccacggacaccgaaaaccacacaaaacagatacaaacttgacctgaccaaacactgctggaaatacccccagagtgttcatcgccccccacccccaagaactacccctctacagcccaagcaggctgctcctcaaagccctgctcatgtcctcattgttacggccctgatcttcataaaaacaattggctaccgatgattaaaagaaatctttttttgggggggggggggtgtttcgagacagggtttctctgtatagccctggctgtcctggaactcactttgtagaccaggctggcctcaaactcagaaatctgcctgcctctgcctcccgagtgctgggattaaaggcgtgtgccaccatgtccggctttaaaagaaatctcttaaagcattcagacagtatacgttctttgtagattccaagtcagcaaatggaagcaaccccaggttttaagcaactatatattttactgaacacactatagtctatttacctagttgatgggcattgcagctatttcagtgtctgggctaagtgaacccctgcaagactgtagagaagcctgaattgttctgatttcatgatccattaattatcaactctttccttatgtatattctgtaggtatactgttgtgttttattaaaaaaagataaagaagccagggatatgtctgatggaggtgtggtatggtgtgggagaagggggtgcctctgtgggcccatgctgagacatcccttccctttgagggaccagtcatactatggtatagcatagaatagagtttattcagggcatagggaggggagttgagggggtagtagagacagagaaaggcagagagcgaaagagaggaggtgtgggagaggtagcaggagagggagagaggaagaaagaggaggagtagaagccagtcatgaacatatggagagaagagggggaggggaatgaggagagaaagcacaagagagggtagagaggaagagaagagcaagagcaagagagaggagggggcaagcagccccttttatagtgagtcaggcacacctggctgttgccaagtaactgtggggcagaacctgaagaatacatttttatattaaaagtatttaagtttatattcagtaaaattcaccttttcactaagggaaaaataactgtgtattttgacaaatacatggtcatgtaatggcctctgcaatcaaagtgggattagatagtctttatgtaattacttattttttattattaatatacattagattatattgtttagtggaattcactgtgatatgcccacacatgtgcacagcatagtctgcagacacttggctatctgccttctttctcttagtgtaatgcatttgaggttcatgcgtgttgcagtctttatcaatggcttatttctgtttgttactgagcggtgtgtgctctgtgatccagtccccagttgtagggcacttgggctatttcccatttctggtgagtttaaataaagttgctatagatgtttgcaaataggtttctgcatggacatgcattttggacttgttagctatattgaatttctagaccctgtggccattataaacaaatgtataggaaattcttagatttccatggcagttgtaccaactttacaccgtcatcagcagtgtctgaaagtttcagttggccctggtagcaacattgccgtgttggacctctgttacccccacagatgcatggaaataccttgctgtggttgtagctttcagttttccagtggccaatgatgctaagcacattttaatgtgcttattgtctaatcgcgtatcttctttggtaaactacgtatggaaatcatctaataatttttaatttgggttcttcgttttctggcaaagcgtcgagtattccttatttatctgagatataagtctattataaggtatatggcttatggatattatctctcagcttgttttccattctttgaacaaggcttcatggacatactcactgtggtctgacttaagggtgtcatgtttcgtgtcccacacttttgatctctcagcagctcaaatcgaaaggattctttcctaacatctcatagctgttcacgctacatttaggtctgtaatcaagtttgagctagtgtctatacagcatatgggagtgcaagtcaaagacctaacaatgttcacccactgcggccccactgttctccgtcatttcttcagagggaagcacctttgactctttatcacaaagcaatagttcatagttgtgtgggtccactgaccctccttaagctaattttgaatctttggtccgtggcatgtgcccagctttttgtgagtatcctcttcttttgattcttgtaactttacagttaatttactttttgtgtcttttattgcaaaatctaaaactatcttgtagtccagatgtattgaacagatagtatttatttttatatttatgtcttcggcagaaacaaacccgtactttgtatcatggaggtttccctcctttactgccctttatcttccagatgtggacagaagcaggtaggggtggagagggagaatttggccatgatgctgcttgaaggactctggtgcagagcacaccccactcattctgattgtcaatgactcttgatatgtatgagtatgatggctaatattgataattggcttgcgattcagaaccaccaagaaaacatacctgtaagtgtgtctttgagggtgtttccagaaatgtttaactgagcaagagagactcaccctgagcgtggatggcactgtgctgtgggctgccatcttggactgaataaaagggagagagtaagttgaaatgagtgtcctgactgcaggcgcagtgtgactgctcctgctgccaggcctttcctgctgtgataggctgtacctccttgaactgtgagccaaggcaagccaagcccttccttcctcatgttgcttcttgtcagctattcctccacagcagcgatgcaaacaggaaataagacagcaaaggaatggaccctggccagggtaggatttctacagtgaaggatgtcctgtgagatgctcacacacagagccacagagcatgagtctagttcacagaacagttttctgaagagtagggactttgtgaaaaacctcccagtcccttctcatattttaagtacactgtataggaaggcaaaaaagaaaagtaaatttctgttgttcaatagaaaaaagttcaaaattagcctaacaaggaaactatcttgggagagaatgcaaatgatttgttttgtgtttcctggagatgtgacaggtgccagctgtcaccaaggcctgttttcaaaatgctaaattgacctcaggatcaaaaaaaaagactcccaaattatctaagttgggtgtcctttgatcgcttcggaagttcaggtctagattgaagcttaatttagttcctgcacagcaaatgaaatgtaagagaaaacacagttaccttaccacaaagccaaacgtttacctgcctcagtcttaggtgctgtctactcttgctggcagtagctggtagagtcgcagccgagtcatcagagcagagagaggagagcgaattatagctagagatgaatttgtgttccatttccatagacaccactcagtggccttaagcaaactgttcttcttaaaacctgtcaaatacgaacagtatcacctactaaggagggatgacagaggaccaatcagaggatagaagagtccctgggtgttgggaccagtgtgtttaataaaggttaactatcactctttccccagttacacagtgtcctaagtctgcctcacagatcctgggttttaggtttggggcaagcctgagagactgtgtttctaattagtgctcaggtgacgctgaaagcaacgtttcaggtggcaaggtggtcgtcggtgtttgcaactgcagatgtttgatctgcctagttagacttattcaatactgtctgcaagttagaagctccagggaaacggcaagacgaatgtctgcttaccccaataataacttcatctaaagaatgcgaattagggtttgggcattaatatttttttctaagaaaaaaaaaagtctttgctatggtctatggtctagatatatgttcctcaaaggttcctgttcccttatacctccagggcagtggtgtaagctttaagaggtagggtctaacagaagttaattaaatcccaaacgtccacactgataaaaagagtcccatctgtctttgaagagtgggtagttataacgggaaactaccccaagagtatggccatccctttctgcttcttcacacaggcagggctgtgtgctggcgccaagcttcttggagcccccaccaccagaatcttgaacttcagtacacagcacacaggtattttgttaaagcaaccatgagtgggcagaggcagtgtcccagaaggctcctgtgtcagactggctgaggccttctgcttggttagtctaacccgctgacagccagccctgagaaagaattgtgtacagaatccattacaagtggtttcatttcctctgtgattcacaaaaaagctgaaagttatagaatttcaaacgtatgttgcatctcctaaactacccattttgtgagaaatcaagcccaaagctttgcatgtcttggaagctatacctgaggtgaagttagtctaagtaacaagtctcagtcattgtgaagtattccgatgcacggtttgtcaggtcattgttctttcctcttgtaaatactacccccaagcccccaaaagtcacctatctgaaaggtaaaatgtatttctaaagctcaaggcatttattctgcaaggggtgggggtggagtggggttgaaaaaaaaagagaagccatgtgtttataaaaggttggggcaggggatgagggaagttctgcggtaatgacaggggagttccagaggaagttatgggctctctctcctctctcatgagaaaaaaaagatagagcggtaaacagcttagctgttaacacatctccaaatctacccagccagttatcttccttgcacactcctctttccccttcaccacctctctccttgttttccgtttgggcatctgaaatttaaaaggggaaacagactttagtagtagtaaattcctaagctaaatgctcagaaaatagcttagtatatctttgatgagggatgattatgcttcccgccccctagggagccgcagagtggatttgaaacaaagtatcttttagttacaagtgagtgaagggtttagagatgatttctgatttagtcacttttctccctggctggtacctaagtaacagcctggcagaagcgaccttagggagaagggttcattttgtttcaccattggagaggacacaggagtccacagtggttgggaaggcgcggtagcagatgtgaggcagctgtcacatcaggaagcaggaagaaagggatgctgacgctcagctaactttctcggttttacttaacccaggaccccagtccatgagatgctgtcactcccaggcggatcttccctgctcagttaagactcctaggtgtttcaaaatcccatcgaattaagacttaatcatcacagttctcctaagaatggatctaaacactaagtacataagaacttgttatttcagcatgcaaaggactctacagaatggaatcatacaggaattcctgagctacatcctttttttttttactagtatgatccgagggtcttttcagcctgatccagcaaggacacgcatgatttacattgttttgcatagaagcatataccttagagcctttctcctgggccccatgttacacaaacaaatgctgggcatgtgtgcatctcctccacactacagatctgtgtaaaatgtgcattaatgttctagttgtagtcaaagcagagaatggaggtaataaactgtccagtcatttttggtaaagctcatttgtgaaaatcactgtctggtatgctgggtggtaacccacagttgctgattcgtgtggtctcttgtgaagtatgcctcagggagaagtgaatgcaggcaggctaggagtcttctcaccacgctcccctttccctccctgctcctccagaagtgagattaatattttggatacttgaaaaatgccaaagcaagcaatcttattcatttctaaggtttgaaggataatggaagtttgaattaaaagagactggcaagctgagtatggccacaccctggccaccccagcacgcaggaggctgaaacaggaaaggtttgagtccaagactatacagaactatgtaacaagaccctgtcttataaccaaagatgatccaaaagtgaattgcaatgtgaacatcagccagcaggaaaaccaaaaggtttttggagtcaggccagggaacagacaaccttcctggttaattaaaatattctggtttgccacagttgtggtgggcacctagaatctgaggactcagaaggctgaggcaggaggaggacgagctaacagcctgggatacatagtgagaccctgtcagcgagagaaagaaaagagagaaaggagaaaggacgaaagcgaagggagagagggaagagggaagagagggagggagggacagactattctggccaataaagtatgactgtgcattccctacatgagtactactttcccaagaattaaccatcacctgaaagaacattttctgagtccctgctggctggcagacacgggtgatacacgtgctccaccttggtcagattttcccacagaaccaagagatggatatttacctcatacagacagattcatagaagctaaaagccagcccctcccctgctccaaaggtccctaactaatcctggtattgttgggatttgaactcaagctcactaaataaaaatatttttttaaaagcccacaaatatttgatgatcagattattttcttgtatgaatgataaaagagatctatggagtataattcaatccaatcttttgtgatgatttagaaataatttccatgtcttaccttactaccatcattgggatacccattcattactcaaggatgcagcatacaggttcccacaatttctacatgcaaacactgcctaggctgtttctgctgttgcagagttattgtttttttttaattaagtattttcctcattcccaaaagtcccccgtaccctcccacccacccccactttttggccctggggttcccctgtactgggggatataaagtttgcaagttcaatgggcctctctttccagtgatggccgactaggccatcttgtgatacatatgcagctagagtcaagagctccagggtactggttagttcataatgttgttccacctatagttgcagatccctttagctccttgggtactttctctagttcctccattgggagccctgtgatccatccattagctgactgtgagcatccacttctgtgtttgctaggccccggcatagtctcacaagagacagctatatctgggtcctttcagcaaaatcttgctagtgtatgcaatggtgtcagcgtttggaagctgattatgggatggatccctggatatggcagtctctagatggtccatcctttcgtcacagctccaaactttgtctctgtaactccttccatgggtgttttgttcccaattctaagaaggggcacagtgtccacactttggtcttcgttcttcttgagtttcatgcgtttagcaaattgtatcttatatcttgggtttttgggctaatatccacttatcagtgaggacatattgtgtgagttcctttgtgattgtgttacctcactcaggatgatgccctccaggtccatccatttgcctaggaatttcataaattcattctttttaatagctgagtagtactccattgtgtaaatgtaccacattttctgtatccattcctctgttgaggggcatctggattctttccagcttctggctattataaataaggctgctatgaatatagtagagcatgtgtccttcttaccggttgggacatcttctggatatatgcccaggagaggtattgctggatcctccggtagtactatgtccaattttctgaggaactgccagactgatttccagagtggttgtacaagcttgcaatcccaccaacaatggaggagtgttcctctttctccacatcctcgccagcatctgctgtcacctgaatttttgatcttagccattctgactggtgcgaggtggaatctcagggttgtttttatttgcatttccctgatgattacggatgtagaacattttttcaggtgcttctcagccattccgtgttcctcagttgagaattctttgtttagctctgagccccatttttaatgaggttatctgattttttggaattcatcttcttgagttctttgcatatattggatattaatcccctaactgatttaggattggtaaaaatcctttcccaatctgttggtggcctttttgtcttattgacagtgtcttttgccttacagaagctttgcaattttatgaggtcccatttgtcgattctcgatcttacagcacaagccattgctgttctgttcaggaattttccccctgtgcccatatctttgaggctttcccccactgtctcctctataagttttagtgtctctggttttatgtggagttccttaatccacttagatttgaccttagtacaaggagatagaaatggatcactttgcattcttctacatgataaccgccagttgtgccagcaccatttgttgaaaatgctgtcttttttccactggatgtgtttagctcccttgtcaaagatcaagtgaccgtaggtgtgtggattcatctcagggtcttcaattctgttccattggtctacttgtctgtcactataccactaccatgcagtttttatcacaattgctctgtagtacagctttaggtcaggtatggtgattccaccagaggttcttttatccttgagaagagtttttgctatcctaggtttttttgtattccatatgaatttccagattgccctttctaattcgttgaagaattgagttggaattttgatggggattgcattgaatctgtagattgcttttggcaagatagctatttttactatattgatcctgccaatccatgagcatgggaaatctttccatcttctgagatcttctttaatttctttcttcagagacttgaagttcttatcatacagatctttcacttccttagttagagtcacgccaaggtattttatattatttgtgactattgagaagggtgttgtttccctaatttctttctcagcctgtttatcctttgtgtacagaaaggccattgacttgtttgagttaattttatatccagctacttcactgaagctgtttttcaggcttaggggttctctggtggaatttttagggtcacttatatatactgtcatatcatctgcaaaaagtgatattttgacttcttcctttccaatttgtatccccttgatctccttttgttgtctaattgctctggctaggacttcaagtacaatgttgaataggtagggagggagtggacagccttgtctagtccctgattttagtgggatttcttccagctgttgcagagttatttaagtcaactcattgtttaaaatacaagcaaacaggttactttgtataggcagaaactcagtaacacactagtataaaggaggctaggaacaaaagcaagcactgaaaaatcaagcagtcctactaagttcttgccaatgcgagtcatcttccaaggagctccctaccttttgctaaagaagagatgttcattccaaaacaatagagtcgagttaggaagcttgtaggtgaaggattggaatcaaattgagaagggaataaatttctctacaaacaattcacttcccttcaggctttggttttgtatgacatgaaattatctcgcatgtctctgatgagattcatctcaaattttggaaaatactgtgaatagaaactgcagcttttcaggtcaaacaccaatgggccctaaattgctaccatatgaactgtattcctaagaatacagccaatgtctttgaacaaaattataaaatcttaatgaccatacatgtttcaggtcatagtgttaggtaatacagtaacaaagtaccttgcatggaacttggcctgtagtggttaaaaatagcccccccccccatcacctttgactttcttgatccaagagtgaacatcttcactgaacttttatgacttggtgattaacagcatgtgaaaccttgagaaatcctggaccagtcttagctatgcactcttaggcaagtaatttaaccattctatgccttacttcattttaaaggcggtaacaatgctgcctgtctccctggcttctagggggactaaaagggatactaatgtatctatgagctctgtgaacaataagaggtgttgttactatcgctggttggaggtggtgatgtttggcaaagagaggtaaaaattgacttcatacaaactaaagagagtcagcccaggtgattgaaatataatggtaataaataaggcagatcgcagtggtagggcagcctaaagaaaggtttggtctcaaaagaggaaatgctctgggttgactgcagggccctgaggagctagcgggagatgttgttgagggcaagcaggcctgtccatcagaagttcctgctggggtgttcaggagaaacaggagtgcgatcagctgtgcgggtgggaatgttcagatgagaaaaccacctccaggtcccgaggcaagaactccactgtttctatatgggatgaggggagggaagagaggagcccagagaatggcgaggatcttctaaaagatgccggagggagggagcacaactctcattccagaagaactgaaacgttgacataaaagcagacaacagcgagctgtgtctcccttgcagctttattcaccgtgacagcccctaaagaagtgtacaccgtagacgtcggcagcagtgtgagcctggagtgcgattttgaccgcagagaatgcactgaactggaagggataagagccagtttgcagaaggtagaaaatgatacgtctctgcaaagtgaaagagccaccctgctggaggagcagctgcccctgggaaaggctttgttccacatccctagtgtccaagtgagagattccgggcagtaccgttgcctggtcatctgcggggccgcctgggactacaagtacctgacggtgaaagtcaaaggtgagtgtcccccgcaagtcatctctgacggagggctgtgatagcttacacaacagcatgggtagctcaggccaaaaccagagaccgggtcttaagaggcagccccttcaaaggggcacctgagcggaaatggtttttggcatctggtataagatctaagtcaaggtaacgggggttaaagcttacaatggagccaggggaagccaggaaaatgagcagacaccaggcctcttcctctgctggactcggaaagtaccggctgaaataacctactaatggagccacatctgtgccttcagctccattcccaaggggaacttggaaaccggggaatatggctacctggagtcaagaacatactgtcctgactttccaagaggggaaagcttttggaattaaagtcaggccctataatataatatccataagctgtttaatgacagattggaagcaaccctcaaagatttatttcagtggttgtcttagtcagggcttcaagtgctgtgatgaaacaccatgacaaaaaagcaaactaggaagtaaagggttgactcagtttacacttcccagatcacagtccatcactggaggccatcaggacaggaactcaagcaaggcaggaacttggagactggaggccatagagggtgctacttactgctctgtccctcatggcttgcttagcctgccttcttacagaacccaggactaccagcccagggaaggcaccacccaccatgggctgggccctcccccactgatcattaattgaaaaaataccttaccgctggatctcatggaagcatttcctcaactgagacttctttctctgtagcgactctagcttgtgtcaagttgacacacaaacccagccggtacagtgactatttgaaattcacctggatcctgttaagacaaaagcatataagaacatttccactttattctgagccactatgatgattaagacaacaattgctgtgtgcaaagtttgcccttgtcttagaagtgatgtgggggctgccgagtttgctaagagcatttgctgtgcaggagtaaggatctgaattcaaagtcacatcacctgcagtaaaaacaatttttgtttgtaccctcagtgtcccagagcagtaacaggcaggacctgggagctccctggccagtcagcctagccaaaacagtgaacttaagcccatctcaagagagtgctgtggagaacagtaaggaaagccatcttctgatccttacatgggcatgcccacctagacacatatatatgcacagagaaatatacaccacatactccttatatggacacacactcctgcacacacatgtgcagagtaacattcaccatacaccctccccacacacatgcatacatacaccagggaaatagaaaccatgaaggatatagaaatctaaagtagaaattaatcaatcttttaatgttagagactgaaagctcagcaagggaacaaggtagcaagtcacatcagcaagagtactaaggaagacgtgggtggtgggcagtggagcccctgggaatgtcacttggcagaccgttcagtgagagccggtgacaggaatgaaatgattctgctgctagagacactgtcagagcagagcagagagctaagtcctttaattaacaagaaagctgagagtctgaacggtcatgtcgccagcccttgcctaacacctttcagattcttagccactgcgcttgttatgttattttaccaagccacacaagtgtctgagggaagaagttgatggcatgagaatgtacttcccaatggaagtgtaattacgtggtgcttatgggaagatggcatctgaaggaagaggaagctcccattgatagctacatttaactacaagttggtagctaggagattgctagtatgagaaaaacagatgttgctaaagataaaaggccatgttttcatttggcctactttagatttcactgtgctctagccatagtggaaatcagactagaggttccttaaaaaactaaaagtagtactatcgtttaattgagctatagtactcctaagtataaattcaaaggaccctaagtcagcctaccataaaaacacacaccacatttattgtagaactattcctcttaggcaagtcacagtctagttggccacaacaaatgaatgcataaagaaaatgtagtgtgtatgtttaatggagaattcggccataatgaggaaaataaccatgtcctttataggaaaatggatagaactggaaatccctgtgtaaagagacataatgaagacttgggaagaaatgtataatggtaataggatctatgttttgtactaccattatatgccataggaaaaatggcagggatctttaaaaagccacatttcatactaataagaatccacactctagggagacatgacaattctaaatgtatacacatctgaatatatagcttcaatatgttaaacataaattggaaagatggatattccttccttgaagccctaccctctctcagaagttatttttctaactttttcttttaaattatttttatattttgaaattataattataccattttaatttttttagcaccccaaacacatatctatctttttgcaaagtcattattcttttttcattaattgttgctatagacatatgtatatacataaacgcacataaatacacacaaacacatatatgtatacatatcatacatacatatatatcatacaacctgctcaatctgtacaataccatatatatatactcagtattgaatacccatttggtgtactcttcgctggggaaaactatttctcccactctcaatattccttagttgtctataattgcctttagttttttgtttggagttgaggcctcctggactttttcactttttcctaataaatcccagttctatttgttcaaaaacaattggaaggagaagagtaggaggaggaggaagaagaagaggaaaaggaagaaatagaggaagaggaagaaggggaaggagaagaggaagaagaagggaagaaaaggaagaagagaaagaagaggaagaaggagatgaagaagaagaaaatgaatttgtgcatatgtgagtttttggttcatctctgctatagcagaaaggacaagacatacagaccggaatgacacacttaaccatcctcacctagttaacatgtctagagcaccaactgcagaagacatggtgctttctaggttcgtgcctagccctcaccaatgtagttatctagcaaagaagaacaaagcaaagttattgcaagagaagaacttctcattgagttggaaatcttgaacttttttctttcattcatttttattctttaatctttttttttacagttcagacttcaccctcttctcagtccaccctccaactgttccacatcccacacttcccacaccccactcctctgtctccacaaggatgtccccatgccccaccccaccagacctccccactccctggggccccaagtctctcaagggttaggtacatcttctctcaactgaggctccttgggtgtaaatatctgcatctgactctttcaactgcttgttggacctttcagagggcagtcatgatagaccccaatttgtaagcacaccatagcataagtaatagtgtcaggccttgggcttgagctgaatctcaatttggacccgtcactggacctccttttcctcggtcccttctccagttttgttcctgcagttctttcagatcgacccaggaacaattctgggtcagagtttgtgactgtgggatggcaaccccatccctccacttgatggcctgtctttttactgaaggtggactttacaagttcctctccccactgtagagcatttcatctaaggtccctccctttgagtcctaagagtctctcacctcccagatctctggtacattctggagggtcctcccacctcctacctcctgaggttgcctgtttccattctttgtgctggccttcagggcttcagtcctattcccccctgccccgatcatattcctctcttcccctccctgtcacctttcccacccagatcccatccccacccccaattgctttcttctctttcccaagtgggattgaggtatccatggaaactgaacagctctctattcaataacttggtcagggaagaaataaagaaagaaattaaagactcctggaattcaatgaaaatgaggacacagcatacaaatttatgggacaatgaaagcaatgctaagaggaaaattcatagcactaagtgccctgataaagaaattggagagctcctacactagcaacttaacagcacacctgagagctctagaacaaaaagagaaaaaacacactgaagaggggtagaaggcaggaaatagttaaactcaggacagaaatcaaccaactagaaacaaagagaattatacaaagaatcaacaaaactaaaagctggttctttgaggggatcaacaagataaacccctagccaaactaaataaaggtcccagagacagtatgcaaattaacaaaaccagaaatgaaaagtgagacgtaaaaacagaaactgaggacattaagaaacatcagatcccactacaaaaacctatactcaacaaaactgggaaatctagatgaaatgcattgttttccaaacagataccacataccaaagttaaatcgagagcaggtgaactatctaaacaggcccatatctcctaaggaaatagaaggaattaaaaacctaccaaccaaccaatcaaaaaaaaaaaaaaacccaaaaaacaaaacaaacaaacaaacaaacaaaaaaacagcccagggccagatggctttagtgtagaattccatcagaccttccttcaaagaaatcttgaacttttaaaagtacttccacctctgaaactcatttgctcatcttttcacaagaatattaccccagtccaacttcctcattttatattgttggggataatatctctccaactactttccaatgaaaaatggactgtgaaggcatttctgataatgtaactgtgtagggtgggggtttccatctcttcctgaaaccatgatggttcctttagctaactatctatcctttccgatgatgtgtcctttcatttacaccccacaaggcaaagtctcagccaagcacctggctcctcgtccttccccttctgaatcacctttctttgctcagccaagatcagtttcttgtttgaagccctcccatggaagttgcctggatcgcccctacagcaaactactccaaaaattcgttttccatatttaccccccaaagtcacaaaagtagacataagatacagtatgatatagtgaaatatttctaagaagatgctgaacccagagaaaatgtatggctaatctagaggtgaaatgagtacttgacatttttacttcagatactgtttgattggcagagacagcccaaaacttagttccaagggattgggaggactagaccaaatcatttagtagacagtttcagagtccaagtctctttgaattctggggattgctagattgataaagagaaggcaatctttctgtttgtgttatttcttggcccattgtggtatttttaatacaaagtgctatgataaaatgcagaagttcacatctctccatctcaaggattctactgtttccttgtttacaagctacgaatccaaaatttaccaacctcatacagttcttgtatactttaaataagataatggtcgggttaccaggctagggccacattttatggccacttaacccctcctcttctcaaagttttaaaaagtgtgagcagcatacaagaatgcaaagccatattggaagtgaacatcatgtgacaggtgaatggtggcctggccacatgattttcccctcgcctccctatttggagcatctctgggtgacttacatgggagagcatgaataagagcaaagaccctcttcttccctgccctctcctcttaatctagaagcacagattttcactagaccctgttctagttttatttctgaggcttggataaaataccttgaggaaatacaacttattcttgaagggattgtttggcttagagttccaccttgtattctttttgagggaaaatcaaggcaggagctcagatcacacccagagtcaggagcaatgacaaatgaatgcatgcacatttgcttgcttgtgttcagcttggtttccctacttttatgtagttcaggaccacatgcctaggaaactgcaccacccacagtgggctgggtcttcccatatcaacttaattaagacaataccccatagagatgcccaccaaccaactcaatgtggacagcccctcattaaggtgcttgcctcagatgattctagattgtatccaattgacaattaaagtttaccattacagaccctaatccattcataaaagataagaacatctttcttatgcctggggatatagtacagcagaagagcacttgcctaacatgtacagtgccctgggattaatccctggtgatggaattaatctctggggaaaccctgattctctgtgtctctgaatataactagtcaaattaataagttattacatggaagcagaacagagaaagacagagaggcaaatcacatgggaaaggctctgagcatgtcttcctcctcactgttctacattaggtaaaaaggtcatgccgcaaagcttacagttaagattctgtgagtgctataggtatttaaggcattaaatacataggtatttaaggtttttcacataactgttatccacctgggtaaagtcatgcagggtctataatcccagcacttaggatacggacaccagagggcagcaaatgtaaattcatcctggaatacgtaatgaggtcaaggctagcctaggctacattgagagagcctgtctcaaaaacaaaatctaaaaaatatagttgctattagtttaatatgaaatggtctttccaatgagtgttatgttcttatatattccagcagtttaagaaactaccttatcacacctgttatgattgcctttcaccactgtgatactgcacttgacataagtaagtcaggggagggagaatttattttagctcacagtttcagaggatccagtccatcatgatcagagggatacagcaaaagagaactcccatcatggcttgttttctctttagcttgtttgggttcccagcctgtgggatggtgctgtctatgttcaaggcagacttcccacccactagataactgagcttcttgtccaatcaaattgacaagattaaccatctcaacaactgtggttttaacttcaagattgcttttacttcaatgcctgtactacttatttaaggaaatatttcccagttaatgaaaggcaggactcgctcccccttccatcatcaaaaccccatagttgattgtcaacacttccagctatatacatgtgtagcggtattcgttaatttttaggtgtggcctaagactgttggacagtctttgtgccttcctgactctccaaatatctccttttgggtttagatttccgtgttctagaaagtagaaaatcacacatgaatagttcatttagtgtgcagtcacagaacatatctgtactgagaaataagaaacacaccccagctctttttttttttacagctcatacatgagtccttattttcctcctcctaatcacaaagataatggagggaaaggaagaacttttgagtaaactttctactgatgctgtctgaaaagtgatctattggggtaatctagccctaaccattccctcagctttcaccatccttcaattatgagactgtttagaatacaagagaccacagaatatggcatcctagcacagtgctaggatgtaaatttgtagccttcctactttcaaacattgggtctatccatcttttttcttctgactttggataccactgtcaacctgtcttcagtcaacctcaacaaaaattatgtgtatcaaacaaaacatctttgttgtactgtatgaataaaaactattcaaactatacaagctaatgaacctgagacataggaaatatttttgagtttagaaaaatgtatcacctaagatcaatagtaatcacgtgtttcttcttccattgagtacaactgtacagcaatccaaaacaacatttctttttcttctgttgtccagcttcttacatgaggatagacactaggatcctggaggttccaggtacaggggaggtgcagcttacctgccaggctagaggttatcccctagcagaagtgtcctggcaaaatgtcagtgttcctgccaacaccagccacatcaggacccccgaaggcctctaccaggtcaccagtgttctgcgcctcaagcctcagcctagcagaaacttcagctgcatgttctggaatgctcacatgaaggagctgacttcagccatcattgaccctctgagtaagtgtggcccccatttcctagtcctatcaattagagttcagacgggaaaaatcttaagtgtaacttgtattcacaagagataattgtcattcagaagcttacttctgaataagctttctagatcattttgaactctggctgactggttcaattcagctcttctggatcaaaattcctctcccagctgactggttcaacctgagttctcttggcttctgactgaattgcccacttggcctcaaactaaccggcaatatgtttaatcttctgtttccttctcagtctctggatcgttctgtcttcacctgtctctgtaaaactgcctcctctctctcctctctctgtgtctctctgttgctgtcatctctgtctctgtctgtctctctctccctccactgttctctcttaagccacctctcttccctgtcctcatgagagttgggcatatcctatctctgactcattctgtcaagtctttctcagatttgtcactttgtctgcccctcgttttcatacatggctgcttccttctacaaactaaccaaatcttcaaggtttggaattaaaggtgtgtactaagggtgtgtctgtattccagatatagagattaaaggtgtgtaattccagccagattacatagatctaggtttttggatgtgatcccttgccaaagcagtcatgttgctggattaaaattcctctacaagaaacagatggtgcgctcatatggcttgttcaaaaaggggttctaagagactcttcatgaagtcgagatagaatatcgaagaactacaaacatagaatggggcaaagatctctactgttgagaaagagttaccagtgttggagaggctaccaggagaagacagctgtgaggcagctcctctgggagtgcagcttcgaggagggaagtatgtgacataccacaaccactctgcgggtcccccagtgtcctactggtgcctcccattggctggtttgtgtgtgtgtgtgtgtgtgtgtgtgtgtgtgtgtgtgtgtgtatgtgtgtgtccccgtcccttcttcaccatgtgttccctgaacttgatccaaatgtagagaatccacaaaagaagattgatcagcatgggtttaagccaatagaaagtctgtattagccagctgtccatcatactgtgtgtttgagattatggtgtagttaacctttttcagttaacaagaacagttaccagaagcagaactacagaagccagaaataaagcaaggttagttagtacatttagagaatttcctagaactatgaacttggatggataaggtctttgtttttatttgtcagatggggctgtccttgggctgagttttatgacttgaatggcacatccatcatggagtcagttgtgctaaggtctgaaggcatagtaacctctggagctctattacattccccactggccctagagagtgagttaaaccataggctcattctattttagttcaaggtataagggcccgtggttgatcaaatcaggagaatgacatgtgcagtgagcactaatagcagatagttagccaaggggactacgagaacagacactggcatcaattatctgacttagggctctgtctcttttccttccttccttccttccttccttccttccttccttccttcctttcctttgttctttctttctttctttctttttatgttttcttcaaccatagcaagactttctctaattactcttgatcaattagcatagaaacaacaggctcttcccagggctagacatagttttcttcatctcgtgagaagtctaaacctctccaattttataggatactttctgcaggggaatctaactactctccaccaaatagtcaggggtttggtgatattgctgtcatccagatgaatcagcccataaggcagaatagcaggcatcagaataaggtaagctattatgttaaaggttttgtatattaggcaagtttcaggtccttgtaagtcctgtaatattaatttgtgttgatcctagtcacaatgaatgttgtcagtcagtagactgacagtctagttagttcctatccctctgtagtatgagggctgggctgtctaaacataaccagccatcctggccaacttctggctgggagtgatgaactcccgggggcccttcctgtggcataaagtccgattccccaggttttccctgtttcccaaaggccagaacttttttttaaagaagaattttaggaagcctcagtttcacaaccctaatttttacaatggaaacttttttgtttcctggggcccagtgaaaccttaattttaataggtcacagtgcaggagacagtccatttggcaacagtgtctgtggcttctgctttctcgacctggatgtactgaatccatggtgtaatgccagttgtcttcacagccataggagtagaaagaatcactgtgtagggtcctgtccaagttgttttcagtgccctttagggcagccacttgacttgaacaaatagaaactggtggtgaacttggaggttggctgggtctctcagctagtccaagactgagggtctatagtgactggacagaggaatagtcagagagttctgtcaactgctggtctctgagctcgagaaacagtgggggaggtcttccaaatataatctcatagggagtaagtccctccccatatggggtgaaacaggtctatgcaaagcaaaggaaggaggcctatccacccctctcattggacactaatgagagttttgttagggtttctttttatgtcctggttattcttttgacctggccacaactctgaggtctgtatgcacagtgaagttttcagtcagtgcctaaagctttagctattacttaataggttttgggctgtaagctacgttattgtcagaccccattgggagggggaggctaaatcaggggacgtggaggccaaaaggacctggaggagtttttaaaactactatctgagcagtactggaaaaactggcaagtactgggtggtggtggtggttgttgttgttgttttgatcctcctctggcaggctaaatgttggcaaagtcagttttactgttttgtgatgtgttggcctcttatttggaccccttcctgggaaagggctctctgttttgcattttcttgagcacaaacctggcatctggttgaagcctccacactaggctgtccagtctaggtataacataccttgttttgagcagctcagaagttttgtggaccccaaatgagtggcctggtaaaggtcagttgccagaatcctgcctgttgtttctgagagaacagtctttctttctggagtcctccgtcaacctgtgtgtttaagctgtccatttctcccatggattctcagccagtaccaggtcagggtacaccatcagaatacccatagacccattggtcttagggacatttgtctggtagccaggtcagcaggcaggcaggagaacagcagttcatggaggaagccaaatagcccctaggaggacaaagattttctaatgttcttttccccaacaccaagaaaccctctttctctacagatcatgtcatggacatgtctgctaataaacgtatagcaactgctggtgtatatggtagtggactttccccatctgagagtctgggtcagatctattctgctctcttgactgaggcaccaaatttggacccaaatcctttccgttaaagtaactacagcagctcccacatacctgttgtcatctttcatctcctgacagtcacggatgagcacttctgggttgtcagcaggaaagaaggcagcaggataggcagtggtggggttttaaaactggactcgagggtgggccaggagttgggcctggaactgggtcacacaggcattagacagaattctagtgctccttaaaggagggcctcaactgtgccatggggtgttgtgagcataacatcttgacccagagttaacatcattatgatcattattaattagtctagtagtagctgctatatctcttaaatgggtgggccatcctgtggctacagggtccagtcgtttagacaggtatgtcacagggcatttccgtggccccaaagtctggtttaaaaactcccttctgtcttgtttcatcaacaaacacatgagaaagtttcaagacatctggaaagactagggcttgagtggaagtcagagctgtttttaaagcctcaaatgccttttgtttaatctgagtccagatcagaggaccaaagcctgctctgtgctggtgtagaggccttgctatttccacaaacactcgtatccagaagcagcgatgtcctgctagactgtctctcagacctcagactctcaaacctgtccgttagtctttggaattgggatctgacagatggctgcactcctactcacacaggctcttttgactcccttcagctggcggccaagacaagtagcctccagtgtgttttcatagttcgcgtgaatcttctttgtatccagatcatagtgaacgtcatgtttgggccatgacaagtgctgccatgacgaattagaaacataatcagtcataaagaacctcagctccctcatctcagctcctagtctacgtagacagaccagatgtgacaccctgccttgtgaccccaaacaatagcagcaggataaacacagtcacatcctcccaagtggtcctacctcttaaaaccattgtctagctgattcttctcattcttatcaaccgagctactcacccactgctggctgctgactgctgtgaaccacctcagaaatcagtgaataaaacaaatgcagaagtgaggtgcgaggatgcctgctactctagaacagaaggaaggcagagggtgccggacactctagaacagaaggaaggcagagggtgccggacactctagaacagaaggaaggcagagggtgccggacactctagaacagaaggaaggcagagggtgccggacactctagaacagaaggaaggcagagggtgccagacactctagaacagaaggaaggcagagggtgccggacactctagaacagaaggaaggcagaggatgcctgctactctagaacagaaggaaggcagaggatgccggacactctagaacagaaggaaggcagagggtgccggacactctagaacagaaggaaggcagagggtgccggacactctagaacagaaggaaggcagagggtgccggacactctagaacagaaggaaggcagagggtgccggacactctagaacagaaggaaggcagagggtgccagacactctagaacagaaggaaggcagagggtgccagacactctagaacagaaggtggaggatgtctgacactctagaacagaagactgagtgcactaagttttggtcagcaggtagggagtcatcaggtcattttcctttagaaacagggctgtcctcagccagtggctacattttcactggcatatgtaactgggctaggtcatgggattaaccgtaaaatacctggtagagctggcagaaaagtgaagccctcttgggaccgctcaggtaaggagctagaaaagaacgtggactctgaagccagacttcaaactttcaaatgctatctctgccgcctcttggctttagaacttgactaccctacagagccttctgggaactcagtctcacaggtatacagttacagtaaatgatgatacacatgcttaaaaagttactgtgtaggtaaatgaaatatgatactaacaaggagtagggaggccactttgtcacctccagcaagactcctggcttctttctgagtgcatagggctatggtaagaataggatggatatttttttccatcacatatcttatcattgttaaagggaatgcagttatcttaaaataatagaaaagaatatgtaggtcacccatgctgccataatgaagattctcaaacatgcaatgactcaacacaactgtgtatttctctttacataatacttagagagagagaaaacgcttcaggcagctaaacaactaccttccgtaagtcattcaatgacccaggttatttccatattgttactctgtcattctccgggatatcgtccctgttaaattgtcaaatcagggtcattgccaaatctatatccctgccttcagagaggaaagagtagtagaagagaactttgatgttctaagtcaagatctggagaattcactcttagccggaatttagtttatactacaggctatgtttaagtgctgatgaggtctagaaaagcagcccctcagagagctctatgtctaactattaacctagcactgggaaggaaggagcaggtaagattaccagcaggttgctacatggtagctactagagggagtaggtaagattaataaccagcaggttgctacaaggtaactaacatagactagtcaattcagcctaggaactgagacttaagtctctcctgcagtggtgctgggcttcataccagactgagtggtggcttaggagccaactctatcctccaaatgcattctaagaaaactaaagtcttcaagggtaagcagaaattccatacatggaaggatctatgagcagacctggacagaacaagggttcccaaagacgctgaggcaggggcctggctcacagcactaccttgcaacatgcatgtagtagaaaaaaagcagtgtgatcagttagggtttgcaacacacctctacctgttgcatgtaattttaaaaatatgctatctccttggcagatctgctgcgccatccccactctcggaaaaacccattcttcccagcttagctccgccaatggccagctggtgcctttcccaggagctgcgattatgctcccagcccttcccagctagccaccagctactgcctctctctatctctgcccacctctctgagacttagacagctttattaacttagtacttgtcagatagcataattgctgggagcagaatctcattgttcccaagcatggccacaaactcctttctctttcctcctcctcctcctcctcctcctcctcctcctccttggacccggaagttctacctttacccttcacccagcaattagcttccaccttctttattgacacaatcaagaaccaattcagctcctctccctacatctaccaaactggcccttatctttttggttctagcgttcacatgctcttggataaagatgatagctctggggcttgagttttggatcaagaagatctatatctaaaaccctggctgttttacttccttggaaacaattaccatagacagattagcatccctgaggcttccttggctctaaagtgactctggattatatatatatatccttccttagccagattttcccatggtcccatactctgtagagggaaggtcaagagcagagcagccagcagaaataggcatagggtaacttgtgtgcctattctttgccatgttttcaacatctctgtagccctcttttctctccatctggccagcctgaaggtaccagtgctctgcaaagctgttccccagcctttaaattaaatcgcctcttcactaaatggatgtgtcagtggcagcaccttggttagttcagacaagataaggggtaacttgtatctgaatggctggatttaacatgtcagcccattggggatattctgctctttcaaaaggaccttgctggtgtttaaaattgaataactaacagtgcagagtctaggctcttgagttcttatcagtgagggagaaaatacatttttgagctgagggactttttctacttgaatgagaaaatccagatggtgaagaaaagagagatggaggtagagatagcgacagagacagggtgggagggaggaaaaagaaagatgacgaataggtgggtgggtggaacaacaaagcgacaaaaggactgcatcatagctgaatcacctgctgtctaactttggggacatttctcagcctttcttctttcatgggtgaatgtggagatcaaagaagaggctgcctcactgggtggaggtgaaaggaaaagaacctctacttgagagagatgtggaatgaaggcttaacttcatttccacgtggtagaaaccacacaggaagccacctcagtctgtctcggggccaccttgtgatgagattccggttctctcattcacccaggtcggatggaacccaaagtccccagaacgtggccacttcatgttttcatcccggcctgcaccatcgctttgatcttcctggccatagtgataatccagagaaagaggatctaggggaagctgtattacggaagaaggtgagtgacttacaagccatgtaagcctgtggcctgcgggtcttcagagaagcacttcaagcctagaagggttttgagattaccctggggacattctactccaagaagaacatggtccagtcttcagtgagctgaacccacgctgaagttttgtgttgttttattttggtttttttgttttttaaggggaagtttgttccagggctgaaggagtttggcttgccctccaagcttcatggtagccaagttatagaatcagccagattcccatcaatgataaacaattttttaaaaaaatgtgatatgtgtgcataacagagcaccttgtagccttaaagaaaaaattaaatactgtcatttttcaggggaagaaatgaagctagaggtcatcgttttaagccctactcagaaggtgcagacagagattatatttcttttgatatatagattctagacttaaaaaaaaaataaatacaaggacaaggtacccgcacagcggaaaggagatacaatgatggaagtgtatatgtgtgtgaaaagccatgatgattaggctggagaaatggctcctgagttaagagagtcatcttacagaggacttgagttcaattcccagcatccatatcaggaagttcctgatcacctgtaactccagctccaggggatctaaggtcctcttctagcctcccagggagctaagttagtccaccagagggccctatctgagccaatgctgagggcctagtgggtaaggggttgaatgtacacaactgtggccgacaggaagtcccacctgcctcttcagccatatgtgtcttgcacagagaccaatggcaagtagcatgtgaggatgccataactaattcactgccactgtggtgtagagctcttgagtccttgctagagcagagtcccatgcagagcccattaaactttcatggctgatgaggaaagaggggcttccttccttctcgtcagctgcaccatttgccccttctacactagaccctcataaggaacctgagtcaagagctttaacttctctctcttctacagttctttgggccattgttgtcctgagactacagtaaagatagagaagtctccatccctttctttctagaagcctcctcggctcctgtacagatttattcatcagataatcacaacttatgatgcctgctgagtactgggagggcagccattgccagtccataaaagtgtcttattaactattcctttcatagagccattcaatcctttgttgaaggatccagtgtgaaacaatatgttccagagaagttggcaaattctagttctgttttatcagctaggcttaagtatatgggaactatgtttctctcatcagtagatatatgttcaatatctaaaatgctatgtggtatatatatataagataatgcccaataaaattgtaagttttttcttttttcatccctgacaatttcatacatgcatatatatgaacctatcatgaactttagacattccatccccctttctctactcttacctccccttcctttcctactgacgttttctttccaacaagtctcctctctactttctcgttttctttgtgtgggtggagccccctgagcttaattgaaattgtttgcgggagcatgaggcatgagcgtaggttacttattaaaggtcaactgaccggtagttacaccactgaagaaaatggcacccctttccatagcaaccattacctcccaatagtgcctcagaagggggcatcgtggattccttctcatccataatgaaatgtaggcaggaccaatcttgtgcatatttgagcaaatatacaagctatgctgggttcccgagtgcaccagctatgtctgacgttttgttgatcctccccccaccctctgtctctcatattccttcctccccctcttcccatgatgttccctgagtgttggagggagtgaaatagatatctcatctaaggcagtgcttactcttggattttggtctgttatgggtttctgcaatgctcattaaacttgtagtctactgtctgtaggtgagcatgacagacctgctttggccatttgagtagccatatttaaagcattcacatgctgtagttacaggctacaatattggatactgcagacagccaacatcactgcacatcactgcccagcactgtgataaatgtccccctcaactcctctccaaattacaagctttgcccaggacagaaagcagtgcctttattttgtccatgaaggaactgaggttcagaaaatccgtgtgacttcccaaagtcacacaacatagacagttgaactctaaaatgtgtgactctttttatggcaaaagagcttaattgaaaccagcaatctgaatagtattatccatacaagggaagaggaagtcgtaacccaaagaattaaatgagttctcatttacatgctgggccaatcacgaagccaagtcagagtcccacagaagttacctgtacagagtctagatctgtagagcttattaaactacaggtggcttaaatgaatgaggattaaaaaaaacttggcacatgcaatgagcaataatcaattcaaacatacatatataacaaatgcaaggtgcttatggcagttctcattcatgttatcacatgacttcattaaagcatggtctggacatacaacacagtcactttacactgtgcatgctcttctataactgaatgtcaaggatgctgcagaaacaccttgggtccaagttgagactattctgtgttatggcttgcagtgtttttattgtacatacaaagtcttattatctcattgaaatagaataacttaattctaaaagtatatttcaagacaaggtcttatgtcatacaaataatataagacaaagtctcattacatagctctagctgtcttggaactcactctgtaaacctggccagtctggatctcacaatgatctgcctacccctgcctcagaagtgccaggattaaaggtgtgagccactacatgcctatataaaaacacttttaatatttttctaccacttttcctcaatatgtgtcaaattcatataactttatatttagttgcattagaaattttatttctaaagctgatttaattgctagcttgagtttcattaaaaagttatcaatgagttttgggttgttattaggacagaatttccaaaaatttcttaagtgcccctaaatatacttctgctaatttgtgttgtatatttatgtgagaggtgttctctgccattcaccataaaactattaattttaaatacaactaactcactagtataaaatttttcttttgtctttaataaatggtagaattatatatgcacaaagaattgcttttaaataagttaattatttcataccagtaaatgcttagtttctgtagctatacactgtcacacatacatcctccctcacatacagtttcacacacacacagtcacacactatcacatatacaaatacactcacatacaccttgtcacacacaccctgtctttctctcacacacataccctgtcacacacatacacacacacacacacacacacactcatacacaccctgtcacaacacataccctattacacacatacataccctgtctcacacacgcacacacatacacactcacatataccctgtcacacacacattctcccccacatacagtcacatacacacacagacacaaattcttatatacacacctacaccacacatacacacatccccctccacatacacatagaataaaataaaatatgaataaaacttgggactactatgttcttgtgttttcccatttcatacagacctcttagttactatgtagccccagctaatctcaaactagaaattctcctgcctcagcctcccgagcctggtacaggtatgtatccttggcttcctattgcagtttttaagaactcctttacagtgtatattatgaaagtatcaacaacactttgaaaataaaaagcacagatgtaatacacacacacacacatacacaaacaaatctggttcttgccaagatatgggaaatatggttcttaagatgtgtggagacttgtgtgtgcacaagtgtgtgtatgtgtgcatgtacatgtgtgtgtacatgtctgtgtgcatgtacatctatgttcatatgtgaccaaggtacatcagtatgctgtgtgtagaatacagatatcaaccttgggtgccattcctcaggcaccatatgccgtgtttcctccacacaaagtcttccattatgacgtgaggctgttcactgagccccagggatacattcacctcccaggcatgtgctactgcacccagctctttacacagatgctggggatcaactcggcttctcacccgtgtgcagcagcctctttattgagttattttcccagtcttctcccacattttttattagatacaacaatacagcacacttcaataacagaaaaaacggccataattcttataaaagtctctaaggttttagattcgaatattaatcctcgtttgatcatgagctggtaactagcagtttttcagccaacatcatccagcctagggaccagcaccaggttggtgctgccttagaagaccgagtcgggactttgccagactctaaaccaaaagtcaaaggcgttatgttctggctgcctatggctggtggagaatattaaccctgacctctggcagtaagggggctgccactgaaaaccgagacattccagagcagctcctctgagttgagaattgggttcctttcaaataccaatcttcttgaaggagactaccctggctatggcactgaattgatccttgactctgaaagcccaagctaatgtcaggatggtcatgatggaactggtaaaaagccagataggcaggagcagcgcaggacagtggagagccaggtcctagaagagaatctgataggaaatagcaagtgctatttaaggaagaaataaaactagaaaaacctggtaacagcaactcatcgtgcaaacgtatgcttttgttctcttagcaactctgacatcagtcttttacaccttagttagtgtaaattgagcaatcaagccttttgttctattcctggacagccaggtataaagcgtcagtcaaacaggccattcaaaaaagccacgtgggaacctattttacaagtatatatattcttcacctaacctatgtattcatagaatctatatattcatattttaaaagtttaatttagagttactctacatagaggataataataatgtttctcccagaacccataacaaaaacaaaaagccaagtaaaggtgtgggttgatgcccctcctgttgtttgtcatgggtatcctagagactcccaaaacaatacaaactattgccattgctcttgattgccccccagaacctgatggtgagtccttattctggtagatacaggacacagaaatattaagttggccctacccaggaagcttcttccctgctggccacctttcatagtatctcaggaacaatgtgagctgctaggcgtggggtgagccatcaacaccttacccagcggagagttctgtgagccacaataatgcctgtcatggcaatatatacccatgggtacagtagtagcaataatatcacagttatgaacaatctgatattcatcaatattctgattgaatctaaggcccactctataggaggagctgcctggtagttggtattgtatctgtgaccaagaatccatggttggcgagctcagaggtcccggtggtgaggctactacaatgatgttgctaaagggacaacagtaccaatcatttctctaaatttctatctctatcttcatagatttctgcagctcccagaccccatcatgaagtttctttgtgcagtggacagtggttagcaaagaaactcataatggctcaaagttcagagagtaattgtctatggtgaactcagccaaaataggacatcaatatcgcacccttacctctttaggtttacagactgtcttagttaggctttcactttctgcaacaaaacaccaaagggtttatttggtttatatttccacattgctattcttcaccaaaggaagtcaggacaggaactcaggcagggcaggaccttggaggcaggagctgatgcatgcttgctctacatgctttcttatggaacacaggaccaccaccccaggggtgccactgcctatagtggactgggttcttccccatggatcactaaataagaaaatatcctacatctggatcatgatgttgtagaaaatatttaatctcaatccaggttttctactccacctttgaccatttagttcccagataaaagatactcataacctttatatttacaataagccttaatcagcacaagagctgggcagatatttattctccatgctattatgtctatttcctagccaataatcccattaaataatctgccatgttttgtctgggctgctcttaactccagttagccaacccatgtggccattatttcaagattcttaccccacctcagcttctcctctctccaacttcttctcttcccacctcgtggttctcctctgacccaagcctgggaaccctacatcccgcctatgcctcttctgctcagctattggctgtcagcatctttattcaccaattagggataacttgggagtcaaggtcacatagcattatgtgggtctatatgtggtctctgggagtaaccagtatttcgcatagcaaaagaccaaaccttaacattatggaggcatttcctcatttgaggctccttcttctgcaatgtctctagcttgtgtcaagttgacacaaagccagccaggacaggggtcatcaaggagtaagaaacacattattagaggcggaagttgggaaggacagatctagaatagtgttttccggacattaatgggaccactacactcataagtttacagcagctatagagacctgtataagacctgaactagaggatgccttcacaacatttcagcacagatcagggaggggctcgtgaaccccatactcagctgagaagttattgacaggtgatgtcatctgagggagggaggatcagtgaagggtatgggctctggtatgttggccatgctccagtggatggctggatgtcagaggtgggaggatttggagatagaggggtggtccttggggggggggtgttatgggaagatgaatacaacccaaacccattgtatgcatgtatgaaacgctcaattaataatgagatatatatatattggtttttcgagacagggtttctctgtatagccctggctgtcctggaactcactttgtagaccaggctggcctcgaactcagaaatccacctgcctctgcctcccaagtgctgggattaaaggcgtgcaccaccatgcccggctaataatgatacttttaaagtgaaaagagaggagtaattctgaagctagacacttgtgggagttttgttttatagacaacaaattcccccaccacaacagagaagtgagcagagccaagggtgagcagcttgcatttctttctcacctcctttgctatcttagcttgagttgataaattcaattctctcccaatctccacgggaattggttctagtctcacttagattagggagtcctcacgtcccttagggaaaatggcccaatgtttgcagataacctatatacatcttcacatgggcttgaaataattctgattcctgaaaaatacctatgacagcgcagatgcgagctttgtaaatagtagggacattgcattgtttatggaacaatggcagaaaagaagagtgtattggtcacttttctcaatgcagtccccaaagaccagacaagaagcagcttaggtcatggttggaggggtgatagctcatactggagagggaagccatggcagtgtgagcatgtatgacaattgcttgctcacaccgccctaaggccagaagctccagaggaacaagaagtagagacgagctattaacctcaagaccaaaccccagtgacctacttccttcagctaactcccacctcataaaagtttcacaacttcccgaacagcagcaaccggggaccaagtgttcaaacatggaagcctgtaagggacatttctctttcaaataacaaccaaaagtttatgctggtgtcttttaaatgtctgctctgggttatttattgtcagataagcttacctcaagctgacttttctactcatggagaaggtaatagtaatggaatcataaggaaggggagtctagagcaggggtacccaggcctcctaatcctgacaccctggaatacagctcctcaccttgtggtgagccccgaccattagttattttcattgctacttcatgactgtaaccttgctcctattatgaattgtaatgtaaatatctgatatgcatgataggtaggaagtatatcaggttctagggattccaggaacctcctcagaactctttaaccttgtctgtgtagatacaattgtttccacccctgaccggtacttctgaggtgagcttaaaacatctaattctgagccttcaaacatggaagactctgggtaagaacccagtcttaccttctctgacagatcttatttcctatattataaatatatagggaatatataaaatatgaagtatgtgtatatttcatattttaaagcccccccccagtttaagtatattttgtcctacatctttttagcaatggtctatcaccaagatctgctaacccagtgaaggttccagctccatactctgtatggatgttttccctgaagggcattttgagaagaacacaacatggctgtgtccggatgggttcacacatgctctctcgttgcacagcttagcgaccctggctctggctctgtttgaggctctggatagattgtcatgtggaactagctgccgggggactctggtacttgttgccagatgagcatccatgggaaggtacgagatggaacaatgtggtgttgatggtttgaagtgtgactttaacagtgcactgttgagtttttatcttgtcacagttaggattactattgctgcaataaaaccccatgaccaaaacgcaagttggggaggaaggggtttatacagttatatacttccatatcactgttcatcatcagaagaagccaagacaggaactgaaacaggacagaaacctggaggcagaagctgatagagagaccatgggaggggtgctgttcactggcccgctgctcccatggcctgctcagccttctttcttatagaatcgagggccaccagcttggggataacaacacccacaatgggttgggcccttccctatcaatcgctaattaagaaaatgacttattgggctggagagatggctcagcagttaagagcactgactgctcttccggaggtcctgagttcaattcccaacaagcaaatggtggctcacaaccaactgtaatgggatctgatgccctcttctggtcggtctgaagaaagtgacagtatactcacatactcagctgcagtacaactgggtggcagttttgcaaccaacagtgattaagaaatacattgtggggctagagagatggctaggtggttaagagcactgactgctcttccagaggtcttgacttcaattctcagcaaccacatggtggctcaggatcacctgtaatggaatccagtgcccttttctgttgtgtgtgaagacagcaacaatgtactcatatacgtaaaataaataagtaaataaaacaaacaaatcaaccaatgaaacaaaccccactgcgtcaccagagaccatgtgggtgtacgagtgcagcactgctgtgcccatggtggtatccaggcctatgctgctgcctggagtcatgtctaggactgtagtcctgtcccagacagggtctgtgttgatgtctgaggccgatgttaccaataaaatgttgtgggatgccagcctacggcctacgtgaaccgggtatttctggaaggcaggctggggctgaaagagactagactgtgagaaaagaatgatgaagccaagacaaatttttctctgatcaaggctcgtgagtttactaagagagtgtgcttataagggggaaggcccatgtcctcccccgcgccccacccccccagtccatccttgcatccttggtgctttgtcgccatgtcgccatgctgtcagcacttggttgcttattcaggaatgtctcaggaagataggtagcagaatctcagggcagttgacacttcaaaagaagacagtcaagtcagaaagctgcaccgcaggtggccccacctcagtggtgacaaggtctgtaccagcctgcttcaggttcaggctgggggagactacaataaaaggccatgcagacgaccctggtctgggctgcctgaggccacgttgatgttcaagcactatgctgagctggcaaccataccatcccttacgtaggcagtgtgcgagagacggctctggtgccgtgggttcagaagagctgaccatggtggcaggagggcaggagatggtcctgcccctcaccagctgcagcccccaggtaggagagtaggccatgtgcctcatctgggcagcagaatagagattatcctggtgataggggagcaggcatactggccccatcacttgtctgacatggggcagcatgggtaaaagagaaatgcccccttgcccctcaccaactacttcaggtggaagggctggcccccaaatcatgagagcaggagagctgaccctacttctcactggctacagtacccagagagggtgtcctgcaccttgcctgggtagcagagtagagctgggcccctgcaaaagagctggccctgcaccttgcctgctgtagattgggtgagctagccaggaagtgttagagagcttgccctggtggtgagtgtacaggagagcagagaggctgaccaactcatctaccacccaggctcagatgtagggttttgaattggcttgacctcaactctgaactgctggaactgtagggatgctcctacaaatctaaagctgcagggtctccatgacacagggcaacaacaggctgtccaaaggagtccctgtaagggtccagcaggagccagaagccatgaaccagaccaaagtctcatggcaatgttcatttgcaagtaaatagagtggaccaaagggagttctgtgggactgtgggacagacacactatgacacactatagcttccacagcaagggttttattttggttttttttttttttttttttggtattttactttattctagtttattttattctggggtaaaggttgcaagagcagaggtagatactaagggacaggaagatgaatggggttggagtacatgattcacacacacacacacacacacacacacacacacacacacaaatcaataatttttttttaaaaaaactattcattacaaagccaaaacaaaattctgattaaaaaaaaattctttctaaatgccccatttgataagttggaggtttttaaatattccatactaaagtcatcagaggggtttcatgcaacaactgatgggaacagatgcaaagacccacagccagacactagggagcattcagggaatcctccagaaagcagggagggaggactgcaggagccaaaggggtcaaggacaccgcaagaaaaccacagaatccactaagcacagaaagcagggagggaggactgcaggagccagaggggtcaaggacaccgcaagaaaactacagaatccactaaccagggctcatagaaggtcacagagcctgaactgacaaccagggggcctgcgtgggtctggcttcggccctctgcatatatgttatggttgtgtagcttgatcttctcgtgagactcctaacagtgagaatgggggctgtctctgactcttttgccggcttttgggacccttttcctcctactgggttgccagtccagccctaatagatggggaggttcccggtcttattgcaaattgatatgtcatgtttggttaataacccttagaggcctacccttttctgaagggaaatggaggaagggtggattgggggatggagtggggaaaggaaatgagggaaagaggaagggtaaacggtggttgggtgtaatatataagaaaagaacaaaatttttaaattatgtaaaaaaaaaaaaaaccaggaatacattatgggactatgagctgtcagcaatgaagcaggagcaatgacgtcttttgatggcgttggcaggctcacagctagaaccagcgcaagagacaggatgtgctgtggttgtcagaagggagggttccacactcctgcaggctggttgagtggaaggcgtagggcttcaaatcagggcttctgggacccgcataggcttgggtgtagagcgaagaaaggccttgtgcacacagataagcactgaagaagccaggaaaggtaaacacacggcttgcctcttcgatggaatgaggtgtgcagatagatgctcttcctggaacgccaggaatgatggagttttataacctggcgatcccttgctgtctgatgagacaggctctgctcgtatctcccagacttcatttcttccagacaataccctcccccttcaaaccttgagtaatgacttttagaccacaaaacccatcctcatgtgggatgtcacctgtgctatcttagggccaggccaatgctgacacccacaggccttatgtttacctcggccattcttacctagaccctaaatctcgggcactgtctctgagtcaacagtacctattcctgtgaaagaagccagatgtgttttgtaaagaatctcagtgtaagcatggcttaaattattatatactcgggactgagttcattgttctctgaatactttttttttttaaattgtgctgtgcttaaatatggctaaagtaaaatgatctgggacagactctagaaatcctggttcatcacccgctacaatcaaatcagcctgaaccaggttttcctcttgcctcaccctgatcattttttccttgcctggtataaagcttgcaggggaatggccacacgtgagttatgtgggacaaatggaatgtttacctttcttggtaagatccccttcttttatggtttagcactcatgtgatgtggcacttgagttgaccaaaatgatatagagcaatcagaagactttgaaatacctctgtgtcagaagcttggcatgttcaagctgctgtgtatagcaccacaattccaaacccaccagttatgaaaactgttagtgttctgtctaagctcctctccacagttacctggcaacagctaggtaggcctgatccactataaaaggggcttcttgccctctcctctctctgttgctcctctcttactcttactctcttgatcttgctctgtcctcttgtcacttctcccccctccccctctccctccacatgctcatgaccagcctcctctctctctctctctctctctctctctctctctctctctctctctgcctttctctgactctactaccctcttttttttttgttttttgttttgttttatttttgttttgttttttgagacagggtttctctgtatacccttggctgtcctggaactcactttgtagaccaggttggcctcgaactcagaaatctgcctgcctctgcctcccatgtgctgggattaaaagtgtgcgccaccacgcccagcctctactaccctcttaactcccctgaccatgccccaaataaactctattttatactatactgtcctgtggctggtccctcagggggaagggatgcctcagcatgggccctcagaggcactgctttcccccatacctgactacatctccatagaacatatcccccctctccttatctttttataaacacatcaaaaacaaccccaggaagcctttgtctcatccgtaagagatagcaatcctcagtacaaaattcgatggaaaagaatgaacatgggctctcagactttttcccacgcctaccagcaattgatctgaaagcaattactgtaggcccacagcctgggtacagagccatgggacaaactcgggaagttccacactgaggtctgattacaactgagctctgaatcagcaattagattttcttgacccagcaaattttctcatccgccttggcgagcctgattaaaatacccatttcttcagaaacgaaaatcccaattcctataaaatgatatccttgacccggaggcacctgcttgtgtaggtccgataggctcagtgtctttcttcagtgggactccttcaagtactcaggacagggaagacgtgggaggggcctgagagcagaggtgacaaactctggtctccagcaagcaagcatgtgatgaaaggaggggaggaggcctgaggtgaccagacagggcttgggcaacctgccagctcaactctaactctccactggcaagaagacagacatggaggtgtttatggaatgtctgctagttattaaatgctagataaaaaattaccagattagccaactcacacactggggacctatttatagcttcatggctagaagtaaacaaaccgctaacagcgaggcccgaggcatggatcatttagggtagagacatatttgagaacaccaagaacacataatctcctgaatgtctcatcctctcgcatgcccacgtgctctgcggtattagaacgtctttgttgagtcaacatgatcatgagtattttggttttttgttttttaattatttttcttttatttacttttttttttttttttttttgatcatgagtattttgtaacagacatttaaccatataatcagaaatgtctcaggcctccttatctgacattctgacagtgaagtaactggcagagaaatgagatagctgggaaacctggtacctgttgtcctggggccagggtctctccagagaaacagagcctggagtgggggaggggaaagcagcagagggaaagagacaggtagattcattttaaagggtcagtgcccatgactgtggggagagtgaggctgacctttgtgcagtaggccagcaggtcgaaacagaggcagagtttccatatcacattctccaggcagggtttcttcatctctaggaatttgttctcaaggtctcacctgattagaaggaagctatattggcatataagctatgtagaatttagctgatacaacacattaattataactgtaaagcgcatggcaacatcaagactagcatttgataagattgtgggccctgtagcctatccaagtagatatgacaaatgaaccaagagatgagggagcagccatcttggccatgcacttggctgagagcatagagtaggccagcttgttggaactgccaaagcctttaaaaacagaagtaaagggcctggagagagctctgtggttaagagggtttgcagctcttgcagaggacctaagttcagttcccattgtctctctcactgctgcctgtaactcctgctccagggcatctgacaccctatgaagtgtttcattatagtatagctgtctggggtccatagggtgggtgttgggtaggggtcctaaagtagtgctggagagaaacttagagtggggaaatgggagggtgtatcatgaaaggctttgaaccctgctggtcccgatacatagattactattttttttaaaggtggtttctctctccagtctactttgagaggttatatgtatgttctagtcaatgatttatttatttttcctgtttgtggtctcttcttcccagatctggacctgcggtcttgggagttggaaggatctgatgggaaaccctcaagagacttctggactcaaagtgagaatcttgcaggacctgccatttgcacttttgaaccctttggacggtgacccagggctccgaagaggagcttgtaagactgacaatcttccctctgtctcaagactctctgaacagcaagaccccaatggcactttagacttacccctgggatcctggaccccagtgagggcctaaggctcctaatgactttcagggtgagaacaaaaggaattgctctccgccccacccccacctcctgctttccgcagggagacatggaaattcccagttactaaaatagattgtcaatagagttatttatagccctcatttcctccggggacttggaagcttcagacagggtttttcataaacaaagtcataactgatgtgttttacagcatcctagaatcctggcagcctctgaagttctaattaactggaagcatttaagcaacacgttaagtacccccactgtggtatttgtttctacttttctgtttttaaagtgtgagtcacaaggtaattgttgtaacctgtgatatcactgtttcttgtgtctcttctttcaactacatcttttaaaacaaaacggtgtggggtttggttgttttggtggtagtggtagtgtttctcagtggtatctccttaagaaaaaaaatcatcatgccagtgaattgtttcttcagccatttcagatgggaagctggaatagcctgtcccccaagctaagccttcttccctagctttctgcgtgattttacattgagcattcctgttgctttgtttctataactgtaatgtggtgatgtcattgttagggcacttgagggtgggcgttctggaagtcctttcaggttagtgtttgggggcagggttgctcagaatacataaaggtgctaacttaaactgcagccatggagctcagtgaattcactaaccttcgggctgtccaaatgtgcacattagctactgtgacccctgtaggttagggagcctgaagccagctctttacctggtgtttagactcagcagaatttggagtcaatgggaccaaatggttgtgaaattaagatttgaagtgtgcatcttattttatcaccatctgcccaacaaaacttcagaaaatgcctttgaagcacaaaaatgtaatcgtttatgtgaaatctctgagttgcatttagatgcccattgcagcaaggtggctctctcacagattccacaccttagcctaagataccagacagcaggacagagagaaaagtccttcctggtgtgcaaacttccttacactggacctcgcctctcaggtgtgtgattggtaggccaaatcccgatagccaatcggtgttgggtgctttgtctgctctactgggagtccagtggtacaatggattctggcaaaatgctgccatcttggccctcgctgggctgctttctaggatattcatagagaaagggccgtccagatccagtatcctaaaatcctgagaggagaatataagttagtgtgtctcactataactatctctatgatcggtcacattactatctaacagttaccaaatactatatgcctaatactggtaagcattttatacacaccattggattgaatcctctcaaaatcctcaaaaaggaagttattaatacctccataggcaaggagcccagaacccagagaggtcaggcagtctagttatagatgcctgctttgtttagaagtgaacaagagcatcaaattattaatgtgccctggttattaatgcgccctggttacctgctggatggaacatcaaggtggacttttggcagttgcatacacccagaggtattttggctattcacggattaatttcacacgaagtgtttcagagacatgtgtaggggaagtccgggttcagggggcctaagattcaaaatcaaaagaatgagcagtaaaagaatggtgtttactgcctgcctttatcaggcagtgaacgtgcagcgggcaacgaatgcttgataagtgtgtgtcagtgtgaagtcccatgtaccagccgctgtccccactgcaaaagcagcagagcgctcagacatcatcagctgatttaccagcagcagatttcttcttctagtcccatccctgaagaagcttccagcctaggtacattgcatgggctttgtgctccaggagttcctacacagccctcaacttcaacacaggcaaagtgcttactgatcctcatgtatcttacagggtcccctctacccacaatacctcattgctggaacttcaaatcttcctgaataaaagcttgcccgtggtttaattattacctatactaggagattttcctccagctgtctttcctttggacacagaaatgtgctcactttctctgtctctctgtctctgtctgaatctgtctgtctgtctgtttctgtctctctccctccctccctccatccctccctatctctcattcccatccaatgatgcttacatgttttcgtttttgaactctgaggactggagcacacgttatctccccgcttggactccttgaaagcagagagaaaagaggatcttcccatgcccagagcaccttgtgtgagataggtgctttgtgtgtgactgaccctgaaactttaaatattgaaaataacatgacgctcattagtctgactttttatgaccgtaatgtgattggctaaaaaagtaaataatgggaactttaaaaaatgtaattcaaatataatattatttctattcctcccttcccttcatctaaccccttccatggctccttcctccagtcctcctcatggctcccactcgctctcaaatcaatggcttctttttctttgactactactgtcactgacatgcacataaatatatgagcataacttgctgcctctgttaagtgtcgcttgtgttaatatgattttagagttgaccactttgcattaggaagtcaattagggggccatccccgggagaggataacattcctctttgtggtcttcagttgcctgcagtccttcacctcggactggtgacctttgtgactttcctcttccatattagcaagcctaattgctgttgtccttgatgggtctggttcaggcagtcatgtagttgaagaatcatgaacgtagcttcccagacatttctacaagacgtgatcccacagcagactttccggttctctggttctccgcactcttctacttccatgatgtcccttgagcgttaggtgcaggggctctattatatacatgtccgctgggtctgcacccagatggttagtttatctctgcatatgtaaaaggtaattttaaaaatttctttaacgtttaaatttttataagtatgggcatgtatatatatatatatatatatatatatatatatatatatatatatatatacatgtgtgtgtatgtgtatatgtatatgtagatgtagatgtagatgtagatgtagatgttcaaagaaagccagaaagaggctgatctattagaggtagacttacaggcagctgtgggaaacaggtcttgggtcctctggaagggcaggaagtgctcttaaccactgggccatctctctagccactataatggcatttttttttaaaaagtggattaattctttttagtgttttatatataagtgaagtaaaaataggatttagaagcgtttgaagatttgagaaagagcaatataggctgctctcattcaatcacaaatgtattgagttccattacttttatgtttgtctatttatgaaggtatactttattatatttcatgtaattttctatcctttgaaaaaatctgttatgaatcttaagctagcacatatgctgctggctagttgtaagatattcttcgggcaactgtgacagtgtttgcttaaaccttcctcagcttctggaagatggtagcctgtgacacacacacacacacacacacacacacacacacacacacacacacacacacacacagaacacagagcaaactccatatgaaagtcactgcccccgctacatctctttcactacttttagagtgaatgttaaccacatatttccttggaaattctcaagtgttccctaaggtcaattcttacatatacactggccggtgtgtatggatcttaacagtgttctcctgttcagttcatggggtcagccatggggcagatcagagggctagagaaggctgatctagacgttttctccaggctttccctccaagggccattgctgactgtcttgcccagagcccagagcccagagcccatgaccttctccatgcggcttactgtgctgctgggttccagtaactgctgcctcccttccccttttcaagattaggtgcctaggtcagtctgtctgtcttcttgtctgtctgtctcttactctctcagagagaaagatatagacaggcaacctgcctgccctgtggtacaatactatatccagcccacacatttacaaagactccctttaattaaaagttcacattttccagttccagaccttggctggtaggtcaagctatttcaaagaatgtaatttctttttcttaggtaaagagtgggtactctagttatgcactgctaggattgttctggaatctgtgcccatgcagactaccttcactaagaactcggaaaatacccctgaatttgtgctgttgttattgatattgttatcatgggtgtggcgagcacaagggtccacatagcgcaatgagatttgaagttctttgaaatgtacttcctgtttcaaggtattttgtgagcatgagctgttttatgaccttgtaaaaatagagaatccaggtggtgaggtgcagacagccagttaattgtatttgttttgtgactcaggagatcacctcactgccatcagaagggcacccatcctcttaacacatctgagagtgtttacagaatgagtctgaggcttagcaggtacaagtgcttgtcacacaagcccggtgacctgagttcaaacctcagaacccacagtggaaggagaagagaaaacccacctctgagagttgctctctgacctccacatctgtgtcatggtgtacacacaaacacatgcaaattacatataaaagttgctatcttgtgtcttagttgttgtgtctttattacttttagagtgaatgtgaaccaagtatttccttggaaattctagagcattccctaaggtcaagtcttacacattgatttctgattgattggcttggttagttttgttttgccatgtagtgcggttttgttatcttgacttcttcggggtggttacaggaacacaaatttgttgggaagttgagcgtctcaggcttcttaggtggaccacttactttctggcgtgctttgtattcacattgctactggatgctcttccaaccctggggatgcttaaggcttcactttgcctatgtaacaggttaaagcagtgatacttttacgttttcctgttttgatcacccctggctttgatcctaagcatcactcttcctgtgaccttggaatctgagtgtagtctatcctccccttccctgctcagcctctagctaagtgtttcatttactcaataatttaatcattttgatacattattttgttttaagctacagtgtcttcacctatctatggacttcctaacaataatacccctctcactgaactgtcctatgaagatgatgcatacctgatttaaaaaaagaaaaacctatccaacaaatacagaagtggatgctcacagccatccattggactgagcacagagtccccaatgaaggagctagaaaaaggacacaaggagctgaaggggtttgcagccccatagaagaaacaatatgaactaaccagaacccccagagctcccagggactaaaccaccaaccaaagggtaaacatggagggacccatggctctaggtgcatatgtagcagaggatggccttgtgggacatcaatgggaggagaggcccttggccttgtgaaggctcgatgtcccagtgtaggggaatgccatgacagggaagtgggagtgggtgggttagtgagcaggaggaggggtaataaggatagggggagtttcagaggggaaaccaggaaagaggataaaatttgcaatataaataaagaaaacatctaataaaaaaactgttcaagaaacatgcatttctttccttaataaatatgaattaagaatgaataaattatgtaaattttgaacaaatgattgtgtcaattttctttgaagtttatgttaagagttaactcataaattagtattttgatgatctagatagtccagtgctatcttatttgtggctttagattcttcactgtctttgattaaaatctttgaataattatactttgaaattatttttattagtcaagatatatctcagtaaaataaactctgacttacagcaaagttggaatagagggagaagctagattctcacttgtagtgagtcatatctggtttctagtctgtaattcaaggtaggcttttcaaatgacacagacattaattcatagagccattccccaccaggattcccgtgggttgacacattctgaatgctagatgatagctcgtcatttctattgaaatcagcaagtccaactccgtggtgatgtttcccaccacaccatgcttagagcctgttcacactgctctgaatcagctcactgactgaattctcagtacttcagagaagccactactccctgttcctcatggtgacccaaggggcaagacaagatacataattatacatgaccaggtggtgagtttgcatcacggaatatagcctactcttatgctcatattccaaccactcaaccaagaaagtaaaaccttttccaactgctaacatatttgtctcatagcttttgctgtcttacaagctaccccaaacgcagagatatctgcaaggtgcataataaacagacacagactactggcaggcaatttttcaagacttaaagttgctctcttctctgtctctctgtctgtctctctctacctgtctctctctgtctctctgtctctttgtctctctctctctgtctctctgtctctatctctgtctctctctgtctctatctctctgtgtttctctctttgtctctgtgtttctctctttgtctctgtgtctctctgtatctgtctgtctctgtctgtctgtctgtctctgtctgtctctctgtgtctctttgtctctttgtctctctctatctctgtctctccctatctctgtctctctctgtctctgtctccttctgtctctctctgtttctctgtctctgtgtctctctgtatctctctgtctctgtctctctgtgtctctctgtgtctgtctctctgtttctctctctgtctatctctctgtctctctgtgtctctctgtgtctctgtctctctgtttctctctctgtctatctctctgtctctgtctctgtctctctctctgtctctttctctctctgtctctttctctctctgtctctctgtgtctctctgtgtctctgtatctctctgtttctctctctgtctccatctcccactctctgctctctctctctctctctctctgcttgagactgcacacattctgcattctcctgcgcactctgcttttctcctgtgcacttttcttttctcgaactcgcacactcctacacacctctgtgcgttcccctttcactcacacacacacctcacacacatctcacacacaccacatgcactctcctttcactcacacacacattcttctcttcacactttcatattttctccattcacttcacactctgtccacacacacctcacattctctcttcactctcttcacatttgctctctctctctcacacacacacacacacttctcgtgcacctcactcccacttcactctctctccactctctctccactcgctctctcgcctttttcttgccccagtcttttactgatactccaaaagcagggagagaaaagacattgtattctcattgccaaatcaaattcaaaagaataaccacatcccacaaagaatcaagaattacagttgttccccaaagtttcaagcttacccctatttccaggcttgtggccaaaataataattgcaaagtcatcactatttaaactttaattttttttaacttatacttcagagctcagaggtccgaggtcagctacgtgtgttttcttgtgaagctctaatgataaatgacgtgggcaaagctggcaggcagtggccagaaagaatcaacccttaacccttaactcagcagttctgctagctttctgcttctgcacattgcacacaacgactctcctaagagtctcagtgttttgacttagttttactagtatagaattatatgcattctacaattgcttatccaggaaccactctcaaatgttgtgcaaaacttatttcataacttcaacagctttgccttccttgggtttccaatgttggctctaattcattttctaataatttcttcaaactttctttgcaagtcaagcattaatctggaactcccattgtgcagttgttacattgtttccaagatgagaacacacagcaggcacctgggtcattaggactgtgctgtgctgtgccccaagcctcaatttttaattgtgtaagaatcattgcatctaggaacatcgagtttcacagaattcaccagagcaggagaaaggagtaggaaagtcagatataatagaataattatgcagaccaaggccaaccgaaaagcagtcacgagcagatgaattctatacaactgttgtccaaggctaagattaggagaaatgggaacaactgttgtctacaaaagacagctgtgagctactgacatgtctccaccctggcctactgcaggcagtcccttatttcaggtggcaggtcccctggagggatgtaactactccttctcaggttcccaggcaccatcctttttcacaaggagctgccacaggcttctgagatgtctccatccctttctgcccctttccctctgaaagagacgggaatcctggagtttatgagaaatggagacacccctttcgaggccactgctcatatgtggttgtatcagagtttcaagcaaaagaaagttagtgtctgcagatgggaaggcgggacttccttcattatgaaggggagatcagggacagactcaggacaagtgtgctcaaacattcactcctagcctgagtccaacgccttccaagtttctgttctccgtgcatctgccagctgcggaatgcttggtttgcttctgaatccttagtaatatttagttattcctgcaaccagaaagaacacgatatattttgaacgcctgcttagaaccccctactggtgctctgcctacggttttaggggaaatctctgagcttgctgctttcttcctgcacacacactaatacagaagcagccacatcacctcgattcctttatgaccttatctttactagaacaatgctccaatataacagctactcggtttccaaaaattctacttctccatcaagcctccctcgggtctcaggaagctacgaggaagaggaggcaggaaaaccgtaaatcggtggggatggacgacaccaaggaaataagaccttctagataagagagcagaactgatgctcgtagaagctcacagacaccgtggcagcacgcacaggacctgcacagtcccagtactgagaggggaactggacacgaggcccatccctcaacgcagaaatgttctccaatgaacagccattcacagaagaaaaatcagttttctccagtggagtctcactgggtgtacacacaacacttaagggaggttccatgcccagcagcagacttgcaaacacaaagcaaactgcatggtagtttttggagatgttatctagcaatactttgtttggtctgtttttttgtttttgttttgtctttcctctttataccttgtcttttgcttttctattatgatctctgatttttttgtgtttttatgggttttgtgctctgtgtgtgtgtgtgtgtgtgtgtgtgtgtgtattcatgcaaatacatacaagctttttctctctcttttttttctgtttctttgcttttattctggattgttttattgtttattggcttattttaaaaggtctggggtcatctgggtgggcgtgagaagggtctgagaggagacgatggaagggaaactgtgatcagaatactgtaggaagaagtattttcaattaaaaacagttagaatggagctggcatggtggcgtatgtacgtgatccccgcacttaggaagccaaggcacaagaacctcgtgagttgggagccaccctgggctataaattgaaagccagtctcaaaccaaaagaggaaaatcatatgcaaagtggcttatgtacaaaagaaggactactcatttgtgtaaatgagcagcctagaggtgcaactggtcccatcagaaaacc

SEQ ID NO: 1590 - DNA, 744 bp, Mus musculus
atgctgctcctgctgccgatactgaacctgagcttacaacttcatcctgtagcagctttattcaccgtgacagcccctaaagaagtgtacaccgtagacgtcggcagcagtgtgagcctggagtgcgattttgaccgcagagaatgcactgaactggaagggataagagccagtttgcagaaggtagaaaatgatacgtctctgcaaagtgaaagagccaccctgctggaggagcagctgcccctgggaaaggctttgttccacatccctagtgtccaagtgagagattccgggcagtaccgttgcctggtcatctgcggggccgcctgggactacaagtacctgacggtgaaagtcaaagcttcttacatgaggatagacactaggatcctggaggttccaggtacaggggaggtgcagcttacctgccaggctagaggttatcccctagcagaagtgtcctggcaaaatgtcagtgttcctgccaacaccagccacatcaggacccccgaaggcctctaccaggtcaccagtgttctgcgcctcaagcctcagcctagcagaaacttcagctgcatgttctggaatgctcacatgaaggagctgacttcagccatcattgaccctctgagtcggatggaacccaaagtccccagaacgtggccacttcatgttttcatcccggcctgcaccatcgctttgatcttcctggccatagtgataatccagagaaagaggatctag

SEQ ID NO: 1591 - DNA, 744 bp, Mus musculus; identical to SEQ ID NO: 1590

SEQ ID NO: 1592 - DNA, 79684 bp, Homo sapiens
aatggagcctgtgggctgcgttgcgaacaatgccggcttcattaacataaaaacagcattcttcttggacatatacacatgtgccccaagacaagaatgttaatccaaactgcaccattttgtaagcgccctgctattttgcagaccttggtaaaagtgacacatttcatgggtttttgggccatgagaaacaccctgcctaaccacttgaccacaaggcccacaaaggcccaactaaagaaatatctctatcatatccttctgggcaaaggtccaaggaacaccacgatgacatcccgcctgaacaaggaccagaactgcctcatgacgggaacatcttatcaatatcctaccgggcagcaagccatactgcccagacccctcccgcccatacctataaattaccccagcctgtaagcagcggtaggcactggcgttaggctggtccccgacttctacagtgtgcatatttctttaaccctcgccttcccttcaaaacctaacagggatcagcctgggcaatatggcaaaatgccatctctgcaaaaaaatacgaaaattagctgggtgtggtggcgcatggctgtggttccagctacttgagaggctgaagtggtaggatcgcttgagccccgcaggttgaagttgcaggcagccctgattatgccactgcactccagcctgagtgacagagtcagaccctgtctcaaataaataaataaataaaaataaattagaaacacatacagccctttgttgatttctttaaatgttttcttcttgttatttttcagtaatctaactatactctccattattgcttttaaaaaattatttctgtctttacaaaagtaatttgtgctcatggcagactatttaaaaaacaaaatgaagccaaagaaagaaaataaaaattaactgcaggagaaggaggcaagagagctaactagatgcagccaggagaaacacctctcacagagatcttcccagattttcagagggaaggcatcaagagtggacagagggaagacacagaggctgggctgaagcaggaggaagctgaaaaccctgcatgaggctaccacacactgggacttgttcctggcccccaacaactcctgcagaagggatgagttgaacaggcaaggagaaacatgctcttgcaatgggtctctggaatcacgacaggaagagacccctcaaccactgtggacacttgagttggcaaggagagctgcttagagaagtggtaggggcagagctccaggtgatgtggagcccagtaggtttcgtgcgggagtgtttgtggtggagtacagccagcgatgtccatctccctaggctcaacttgcttccataggagactttagcaccaggggagctgtcggtcctaaattctgcagggcggtgttgcccatgagatagggccagtctgacttcagcaccctttggtctgctagcctttcccagggccccagcctgtccatgcctgcttgcagtgcagccaccaggtacctcctgggagcccacatcatagcacctgtgctggcagaccatgccagactgtcagagtgctgcagcagagtagcccccatggacacacaccagcccacccagctcatcccctaactacagcctcccccttgttgctttgcttgcacacacttgcccacagccacccttcatatcactttgccagtacctgcgtgtacaggcagacctcaccttcccttccccaccagcatacgtgtgagcgtgtgccctgccatgccactgctgctggtgtgagtatatcctgcccctcctttccctgcagcactgtccactgtgatggcaatggcattgtcatcagagtgttgttgggcatggagctgccagctccgccccagccagtccccagccctgcccctatgcgaacactgcctatggcacaaaactaggcacaaaaaccagcaggcccacccctgccctgagcggccaatgcctcccatgtgaatgtgcacagggggcacacacagccctgcatctagcagcatcctgctcccatgctaatcccaacactggcacaaacatgtgtacagttgctggtgagggccccccaacctgcctgagccatgctgccactgctgcttctatgaacacctgcacgaaggctggcactccggcatccactagcaccttgctgcagccaacaagtgtgcaccccactgcaccgctgctgccactgcgactggcacatgcgactgaggatggatcatgtttccacagccctacaaagcactttggctggcaccatgcctcagagagttgtgatcagaggtccaggagcacctcaggcccctccaacatagcaggttcctaaccttaaggagccagagaacaagaccggggcctgataccagtgccccagagttataacacacagtttgggagtcctgagctgagacttgggcccctaaaatcttccagaaatgaagccagtctactgaacccaccttataccacaatcaaaccccgaaggtcattaaatatgatataaaaagggggaaaaaaaaacaaaaacagcaacatcaaagattgaaggaacatcattctacaaagatgagaaagaaccaagataagaactctaacaactaaaaagccagatggtcttctttcctccaaacaatcacactagttctccaataatggttcttaaccaggctgagatagctgaaatgacagaagtagaattcagaatattgataagaacaaagatcatcgcaattcaggagaacactgaaacccaatttaaggaagctaagaatcacaataaaacaatacaggaggtgacagacaaaatagccagtatagaaaagaatgtaactaaactgatagagctgaaaaatatactacaagaatttcataatgcaattgcaagtattaatagcagaatagaacaagctgaggaaagaatctcagagcttgaagactgactttctgaattaagacagacaaggagacagtcagacaagaacagagaaaaaagaataaaaaggaacaaacaaaacctttaagaaaaatgagattatgtaaacagaccaaatctatgacttattggtgtccttgaaagagatggggagaatgggagcaacctggaaaacatattccagcatatcattcatgagaacttcccaacctagctagagaggccaacattcaaattcaggaaatgcagagaacccccacaagatacttcacaagactgtccccaagacacataattatcagattctccaagatggaaatgaaagaaaaaaatgctaaaggcagctacatagaaaggaaaggccatctacaaagggaagcccatcagactaatagtagacctctcagcagaaatcctacgagccagaagagattggaggcctatattcaacattattaaagaaaagaaattccaaccaagaatttcatatccagccaaactaagattcataagtgaagaaataagatatttttcagacaactcaacgctgaggtaatacattaccaccaggcctgcctaacaagagttcctgaaagaagcactaaatataataaggaaagacagttaccagcctctacaaaaatgcagttaagtatatagaccagtgacagtataaagaaaccacacaaacaatgcacagaatggcaagctggataaagaagcaagacccaatggcatactgtcttcaagggactcatatcacatgcagtaacacacataggctcaaaataaagggatgggaaaaaatttaccaagaaaatagaaaacagaaaaaagcaggggttgcaatcctaatttcagacaaaacagactttaaaccaacaaagaccaaaaaagaagaagaagggcattacataatgataaagagttcaacaagaagatataactatcctaaatatatatgcacccaacacaggagcactcagattcataaagcaagttcttagagaccttcaaagagactcagactcccatacaacaatagggggagacttcaacaccccactgacaatattagacagatcatcaagtcagaaaattaaaaaagatattcaggacctgaacttaacactggaccaaatggacctcatagacgtctacagaactctccacccaaaaacaacagaatatacattcttctcactgcctgccacatggcacatactcccaaatcaacgacaccatcagacataaaacaatcatcagcaaatgcaaaagaccaaaatcataccaaccactctgtagaaccacagtgaaataaaaatagaaatcaagactaaaaaaaaaattgctcagaaccattcaattacatggaaattaaacaatctgctcctgcatgacatttgggtaaataatgaaataaaggcagaaatcattaagtttttttaaaccaatgaaaacaaagacacaacataccagaatctccaggacacagctaaggcagcgttacaagggaaatttatagcactaggtgcccacatcaaaaagttagaaaggtctcaaattaacaacctaacaccacaacaaaaagaactagagaagtaagagcaaaccaaccccaaagctagcagaagacgagaaataaccaaaatcagagctgaaatgcaggagaatgagacatgaaaaaccattcacaagatcaatgaatccaggagctggttttctgaaaaaataaataagatagatagactgctagctagactaataaagaagaaaagagagaaaatccaaataaacacaatcagaaacaacaaagggaatattaccactcaccccgtagaaatacaaataaccatcggagactactatgaacacctctatgcacacaaactagaaaatctagaagaaatttataaatgcttggacacatacacccccaagactaaaccaggaagaaactgaatccctgcacagatgaataatgagctccattactgaatcagtaataaatagcctaccaacccccacccccaaaaaaatgcccaggacctgatggattcacagtcaaattctaccagatgtacaaagaagagctgacaccattcctagataaattattccaaaaaaattgaggagaaggggctcctccccaggtcattctatgaggccagcataatcctgatactaaaacctggaagagacacaataacatcaacaaaaaacttcaggccaatatccttgatggacattgatgcaagaatccttaacaaaatactaacacactgaatgcagcagcacatcaaaaagcaaatccaccatgatctagtaggctttatacccaggaggcaaggttggttcaacatactcaaatcaataaatgtgattaattacatagacaggactaaagacaaaaaccacatgattatctcaatagatgtagaaaggttttttataaaattcaacatttctttatgttaaaaatgctcaacaaactaggtattgaaagaacatgcctcaaaataagagccaactatgacgaactcacagccaacatcatactgaataggcaaaggctggaagcattccccttgaaaaccagcacaagacaaaaatgccctctctcaccactcctattcaacatagtattggaagtcctggccagagcactcaggcaagagaaagaaagaaaaggcatccaaataggaagaagggaagttaaacaatccctgtttgcagatgacatgattctatatctagaaaacccctagtctcagcccaaatgctccttaagctgataaacaacttcagcaaagtttcaggatacaaaataaatgtacaaaaatcactagcattcctatacaccagcaacagcgaagccgagagccaaatcaggaacacaattgcacttgcaatttccacaaaaaaaaaaaaaatacctacgaatacagctaaacagggaggtgaaagagctctacaatgagaattacaaaatactgctagaagaaattagagattacacaaacaaatgggaaaacattccatgctcatggataggaagaatcaatatcattaaaacgaccaaagcggtttatagattcaatgctgtttccaccaaactaccagtgatattcttcactgaactagaaaaaaatattttaaaatttatatggaaccaacaaagagcccaaatagccaaggcaatcaaagcaaaaagaacaaagccagaggcatcatcctaccagacttcaaactatactacaagggtacagtaaccaaaacaccatggttctggtacaaaaacagacacatagaccaatggaacagaatagagaacccagaaataaggctgcacacctacaattatctgatctttgacaaagctgacaaaaacaagcaatggagaaaggacttcctactcaataaatggggctgggataactggctagccatatacagaagatggaaactagactccttccttacaccagatacagaaatcaacttaagatggattaacaacttaaatgtaaaacctaaaactataaaaaaccctggaagacaatataggcaataccattctggacatagaagtgagtgaagatttcatgacaaagacaccaaaagcaattgcaacaaaagcaaaaattgacaaatgggatctaattaaactaaagagcttctacacagcaacagaaactatcaacaaagtaaacacacaacctacagaatgggagaaaagttttgcaaactatgcatctgacaaaggtctaatatccagtatctataaggaacttaaacaaatttacaagaagaaaacaaacaacccaattaaaaagtgggcaaaggacatgaacaggcgtttttcaaaagaagacatacacatggccaacaagcatataaaaaagctcaatattacttatcattaaagaaatgcaaatccaaatcacaatgagagatcctctcacaccagtcagaatggctattattaaaaagttaataagttggccgggtgcggtggctcacacctgtaatcccagcactttggaaggctgaggcaggtagatcacaaggtcaggagatccagaccatccaggctaacatggtgaaaccccgtctctgctaaaaatacaaaaaaattagccgggcgtggtggcgggcgcctgtagtcccagctactcaggaggctgaggcaggagaatggcatgaacccaggaggtggagcttgcagtgagctgagatctcaccactgtactccagcctggaagacagagtgagactccatctcaaaaaaaaaaagttaataaacaacacgctgacaaggttatggagaaaagggaatgcttatacactattggtggagtgtaaattagttcaaccattatggaaagcagtgtggcaattcctcaaagagctaaaaacagaactaccattcaatccagcaatcccattactgggtatatacccaaagaaatgtaaatcattctatcacaaagacacatgcacacacatgttcatcatagcactattcacaatagcaaagacatggaatcaacctaaatgcccatcaacgacagactggataaagaaaatgtggtacatatacaccaaggaatactatagagccgtaaaaaagagcatgtcctttgcgggaacatggatggagctggaagtcattatgcttagcaaattaatgcaggaacagaaaaccaaataccacatgtgttcacatataagtgggagctaagtgataagaacacatggacacaaagaggggaacaacacaaactggagcctagctgagggtggaggccccagggaggagggagatgagcaaaaaaaaaaaaaaaaaaaaaaaaaaaaaaaaaaaatgactgggttctaggcttagtatctaggggacaaaataatctgtatgacaaacctccatgacacgagtttacctatgtaaaataaaagtttaacaaaaaactaaaaaagttacctatgtaaaacaaaagtttaacaaaaaactaaaaaaagttacctccacccagaaatgcctttattaacactttggtttgtaaccctccattattttctctagacatatagatttatgaggcaggctaatgtgctgagacactagcttgagtttcatttggccttgctgtgaatatacctgggccttcctttgcttcaggatgccctaaactgtggcaaagcagagctgaactgcccaaaggaaagtgtgaagaggagaggcaggccaagcctggagaaaggctacccaagagagaggaaaggaaactgtggtgagtgcacctcactcctaaagaaggacaggaactctggtaggtgaggtgtgttttccatagatactaaaactcaaagccacacaggggacatatgtccattcctcagccagtcactgtggccaggaacagagggtcaggtaagagaatggcaactcctaaggaaaccacatgcctggagccgtgggtgtagaagcagatccccagaggaagcacgggtcccacagacacagtcccaactcttgccgtctaggcagccactcccatctgtaggtactacacagcttcgtagtacttcttaaagtacttcttgttcaagcgatgggacgaaaagaggatgcaggacaaggaggaggaaaggagatccttgcttttgtagaagaaacaaggaggcagggaaggcttagaggacaggcaaggagagatgttttcttaaaaacatcctctgtctgagtgttcagccccacatctctgctggtcctacccctataagcacaaggaaaagggcgggaggcagcaggagaaggattgatcattcaggcctatattcaagtttgccttttcttgccatgtggttttaatctcaccaatcacaagcctgaaggtatagtggggccactgaggtccgagttcaaattcagccatgcaactaaggaaacattgtttgatcttggtcctgttttctcatgtgtaaaatgggtctaactctaaaccacacattgcactgagaatgaaatgaggcactatgaaatgaagtgaggttagttgaataatgttccccccaaattcatgtctactgaggacctcagaatgtgactatatttggaagtagggtctacgcagatgtagtctaaatgaggtcatactgcattagggtgggcactaatcaaacggatggtatcctcataagaggagaggaatgtagagatacacacagaaaagaatgtcatttgaagatggaggcagagattggagtgatacaactataagtcagggaatgccaaggacttgaggtcatgtgttacagaagccctaggaaatgagtcaatttcctggcacagcactaagacatgctggtattcttcattccatccctttcccctattcctaaatgtgctccagggacaatggggaagctggagcacatataagaataggggaaagagagggaataaaagggtattaaaaactctcaaggtatgttaaaaaaaagactctcaacaaaccaggtattgaaggaacatacctcaaaataataagagccatctatgatgaacccacagccaacatcacactgaataggcaaaagctggaaggatgccccttgaaaaccggcacaagacaaggctgccttctctcaccactcctattcaccatactattggaagtcctggccagagcaatcaggcaagagaaagaaagaaaaggcatccaagaaggaagagaggaagtcaaactacccatgtttgcagatgacataattttatatctagaaaatcccacagtctcagcccaaaagctccttaagctgataaacttcagaaagtttcaggatcccacatgaacatacaaaaatcactagtattcctaaacaccaaccatagctaagccaagagccaaatcaggaatgcaatcccattcacagacaaactgctaaaagcaaaaccaaaactttccaaataagccaggctttcgtcagttcctcagaactagttctggtttgactcactctcatgttacggcaaaccttaagctgaatgaacaacttttcttctcttgaatatatcttaacgccaaattttgagtgcttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatgtgagtaacgagtgggttgagatactctcatactattatgttgtggaccatgatgaggctgccagggtgggggaagggtggcctaccttctctccacaccatttgaggcaagagacattctgcctcagaaattgtgctgaggggcacaaataagctaatgtcctcctgccccagatttctctcacttgttcctatgcatattgttcttgttgctcagttttataaggtgagatattttctgcaccaaatatgtgcactgtaaaataatataactattcttaagattgtctctcagcttagagttttcggaggcttaatggtgaagaacttaaaaatctgttttcctatgactgacatctgtttgtgattatccatttagcagacggtgatccctccaggctggcctttgtttacaagctatgcctaagaggcagctgttggtggagggggaacaaaaacaaaaaacccaaaactattatcttaataacttatagaggtaatcattattgaacaaaagcatgatttggggactatggaaaggcttattctttccatataaaatgatcagcgaaaaggtagaaaaattaaacagaactgaaataattgctattgattgctcaccgcctggatgcactgagtagaagagcaaaggcaatgggttcatgtggaggggatggaggtggagaggctaagcctgagtgagattaccaactaatcaggacttttaacccaaaaatactatggctctgaggggcagggaatgagagacctaaattgacaaaatgcagagtaaaaatattcagtgtgagcagtaatgagacagttgtatcagggtcaaatacggagttggcctggatgtcctccaagctcctttccaagcctaagattctgtgagtggatgaacaatcctggtcctgctgctcttgccactggaacctgatctatttgccttcattatttgaggtctccccatcatcaggctctttgttgtctgctgcttcagggtgtcttctccccagatttctcctgttggtgagcttttccattgaactggagctcctcacaggcaagaagcacacctttaaggttctctgagtcccaagttcctagtgcagtacctggcaatacacataggtgcttagtgggtgcttgccgaattgttgaatggatttatttgatgaaatgtcaggagaatcaccagaaatgaaatgttcgtgtaatggacagggggaagtttgaggttgatttgaaaaaggagatggtagagacagtattatgggtcatgcttcagagtttatttgctttacaatacattggacagcaaccagtagattgttgtgtgtcattttaattccacatgctaatgtccaaatatgtcatatgtcttaattgttgcatacgtgggttactctgtaaaggggcaactgtagtatcacctcctcatgccacaccctgctccactgtagctgggctcgataaccttcaaatcaactcacagaattccaggacagacaagagcatctgaaaggttatctagccccagtcacctctgatgccttccagctgtctctaacacacctgtgggctgacttccagttcttagtcttcacggctccctatgatgaactgcccctgctttgagggattttcctccattgcctcagaagtactgccctgggggagcttctgatgctcttctgaccaccttgtctctgcctttttcactagtcctctgttcctgctctccaaattttgggacgttcctgagttcagatcttttctttataatctttcttttatattctccccatcagatggttcattcattcctcaatattaactaacatttccatattagaaataacttccttatctttagccctaaattttgtcccaaactctggacctacaattttttggaatgcttatgccttgcccagactaaaaccaaacttactgtcttccctctaaaatcagctccccatcttctatttctccctgccacccttcctcccccatggctccaatattgtcttgccagtctggtcttaaaaccacagtcaatcttgttgcttttctctttgtctcttgtgcatggctgatcagcagtcaattgttttgtcaattgtcttatatgtttcttcttcctcttccttgcttcctttttctgacctgaagttagggccttgttaccaaacatctagatgaatacagtgaccccctaattgagaggctgtctaccaattccacccaccctcaattctatactcaaaaaaaaaattagatgtaatctttttcagatactcctttggtattgtcacttagtttttgagtgactgccactatttcccgattggcagctctgcctggcattaagctcttgacattctcaacctaagtgtccagccaagttactctgttcattgtcccctcaacacgcctgtgcatttgcacctctgagactgcttctgagtcagctatgcactgccctttagaatagcttcaaccccaaatcctaccagtgcttcaaaggcccagttcaaatcctacccctctgggaagtctcccttcctttagtcaacttctagggcttttgcaattttatcacttgttttacatcagttttactatttttcatgtgtgagagttttaaccttccaattatggtacaatgtctttaagggcaagggccctttcttagaggaaaccctctatgaattctccaatgataaattattctatgaattctcacaactttctaatataaaggcttataaaaagtgggaactcactgtttattgcttaaaaaattgagatttaatttgaacttaaatgctctattaaattgagtagaatagcatcttaaggctactggtagtctatctatgccacagatggtttagagatcaaataattactcatatacctatgacagcagagtactggctgtaagatccccccaaaactcaaatacctattgggtttgtcaggcaacaaaaataagtgaatccagctaggtctaatacaatggaaaatggtaggacctggggcaaactctgcataacttgcccaaaggcattcaaattcagattatgttcagacattgctaattacaattagtgtcttagacacttggcttcaaaacagtggttagttcaggtatttcagatcaattgggtatgcatttatctaggtcttcatggatagccgggctctactagacactgggagagggaagaggcaaatgggataagactggcagtatttaacaaagaatgaagtattttacaaacatgatcctttaggctggttattgttacacaaaggaatgatttgctaggattcttgagatacttccatagaatgtctatgcctcacttattgcacagaccagagaattccataaaagcactggctgtgtcttatttacccttgtatactagagcttggcacatagtaaataccaagtaaatgttttgaataaaagaaagagataattaaagcttcagcaccacaattatttgtatttcatctatcagtttggaaatagatctccacagacagtagaaatggcaagaaactaggcctatagcaaccaagaagtgaaactgctagaacctaccatcatttctgatcctcttgcaaattttgcttgaaaaaaatttcctcattttctgtttacgaacttatcctcagaatttacagatgtttccttgatttctctggaaagatacaacttcctaatgcaattgagtaaattgatacttcttatgtagaaataagcagaataagctgggcaaggtagcccacaactatagtcccagctacttgggaggctggggcaggaggatcacttgaagccagagtttgcttgaggccaggaattcgaggctgcagtgctctatgatcacacctgtgaatagccactacactccaggctaggcaatgagtgagacctagtctctaaagaaaaaaaaaaaaaaaaaaaaaagacaaaataagatcaaaattgagtatgaactgataaatacaaggtagacaagaaatatcctgagaggcgcaatcgttctgcagacatttgcttgggaagctcaggggaggatttatgaaggaggtagccctgagtgagtcttaaaaaatgggtagacttttaccaggcaagatcttagtgaagttagtgagaggagtggtcatataggaattcatgggatttttagaccaaagattaccaccctcataagtgataatgacgatgaatgtgaagaatgtttaccacttgcaaagtatttttcacataccttgtccaagttcccacaagcatttctgttcactacctgtggtttggtcaagagacccagatattagagaacgtgttgatttctagtttctaactccgcccaataacattaagatgaaaatggatagccacataggaacagacatcaataaacatatttagaaaacacaagtgaattttaaaaggggagacttaagaggtggcatggttgtttgaacatgttcgtttttgtctcctggagaaaagtcagcacaatgctcattcagctacataagtgtttctgttacagctctttcagtccaccattcggcaggtcctgaattcttgtcccttgtccagaaaaaatgaggtatgtggacaactggagggtgagcaaggcggagaggagcttcgttgagtgacagaacagctttcaggagacccaaagtgggtagcacttttccataggcaggaaatgagtgttcaactctcagcagagaggagacccacaatggatagctccttaccacaggcaggtcatcccagagaggtgaggagacacaagccaggcacagtggctcacgcctgtaatcccagcactttgggaggccgaggcgggtggatcacgaggtcagagttcgagaccagcttggccaagatggtgaaactccatctctactaaaaatatgaaaaattagccaggtgcagttgtgcacgcctgttgtcccagttactcaggaggctgaggcaggagaatcacttgaacccgggaggcggaggatgcagtgagccaagatcacaccactgcactccagcctgggtgagagagcaagactccatctcaaaaaaaaaaaaaaaaaaaaaaaaaaagaaaagaaagaaagaaagaggagatctgaagtgagcaactgcttcccctagctggtagtcccaatgtctgttcaagtctggctgagtccagggttttgtgtttgtttgttttgtttttttgagacggagtctcactctgtcaccagggctggagtgcagtggcgcaatctcggctcactgcaacctctgcctcccgggttcaagcgattctcctgcttcagcctcccgagtagctggtattacagacacccaccactacatccagctaattttttgtatttttagtagagacggggtttcgccatgttggccaggctggtctcaaactcctgacctcgtgattttcctgcctcggcctcccaagtgctgggattacaggcatgagccactgagcccggtcgagtccagggtttttacaggctcagaagggaggaagagtgtgctgattggcccatgggcagccatggaagggcccagaaaaagcactgtaagttcttaccccaggctgtggactccacccacaattggcaacctggctcccaggctttgggccatccctggcttgaaggttgggtttcaccagggacctaacccctttccgccaaggaacctgtctccctcttgccatcaacatgctgtccatgatgcccaggctgttcgtgccgaggggtgcctgcaggcctgccctgagccaccctcagcccctgctcagcctccctctgtgcttgtcagcacccaacatctggaagaggtcgaggcagcagggggctagtgtgtcagtaccatcctgagcacccacatgcctggccgggttgtgacagcacctaggcttggccacaactttgcttcacccagtagcaggtgccaggagtgggaagaggccagggagtgggagcaggcactttcaaccttgtgggagcaggggacttcctgggcccctgagagtacagagatgcctgggtccagagccactgctgggcagctacaggggtgcctgggagcatgcggttcccaccccgccaactcagtacggggcgggactcccacctgttcttggcctccctggccacacctccactgctgcagctgctctaaacgggcagctgctgccatcactgtgagctatgattgtgccactgactccagcctgggcaacagaaagagacctatatggtatgttaaatggtaatgactgctttgggggagaaaagatgactaaggattgttgggaatgctggggtagggttggagtgctcttgcaattttacataagacagtctcaggagaaaaaacaatgaaagtgtccgggtagagggacatgtacactggcagcaaggtcttcccttagggattggatctgcggaagaggccacacaggcctggaagcaggcttaaggccattcaggctaggaattccagtgtttcaaagacagactgcaatggatggcggttggtaggtcaaaagctccagataacatctctcagccctgcgaacaccttactctcggggagaaggatgggcacagtgggtcctttaaagcatggggtccaggacaggggcctcttgtcttggctgttgaaaaaactgggttttacactgagtgaaatgctgagccatcggaaggttttaagcaaatatggtttgacttttattttttaaaaaccactctggctgcagaatcaactgcaggaaggcaaaactggaatcatagcatccagttgtcagactaatgcagaaatcaccatgagaaatgacaatgactctgaccgatatggaagcagtggaggtggtgagaaatggtcagattctggatatatttgaaggaagggccaatagggttggttaatgaatcagatgtagagtgagaaaagaaaggactcaagatgactccaaggttcttgtccttcacctcaataagtggaggatggagcagaggaaggcaagactagaaggtaaaaatagcagtgagaaggctctgctatggtataagaagaaatgataagaagctgaattaaggtgatggcagtggggtggaagaaaggagagccaccatgcaaaaagtatccaggagggagaattaacaggactaggggatgggccatatttgcaagatgagaaatgcagaggtctaagattctagcttaaggtgggtgttgctactattagcataataggaaaacaaggcacaaagacttttcaaaatttgtccaaggtgttagaggcttacaatttgtaaaaccaggattaaacccagatgtgtctgattttagagcctgagctcttactcattgcataaaccatattttccccagaggaggattagtaggaaaggaagctgctggttggaaagtatctttatagcagtgtctgttcctcggtttgctcaaggggacagtgtgccaggaaagtccccgtggaagggcaaggaagaaggggaagttaaagccagtggcaggtgatccaagaatcttttctgttgctagagctatgttacatgctgtcctttcatgctctaaaaataagagtgctggcaagtgccaggcctgttggtgcagcttaagatgatacctttcttggatatatatgcatctgaataaggaaggctatcttctggtcaagctaaggtatgccatgagcatttccctgtggaaagcacttaattctgttcccagttgttacctgctgtaagatctccctttctaaaataaaaacaagaatacagctcactgaggaccttacatttccctctagctactgactcatttctcttctcctttttatagcactcttcttgagagagttgcctatatttgttgccacatctttacccattctcttttgaacctattcaagctttcatctgtacaaaactcactgatactgtgcttgtcaggatcatccatgacctccatactgctaaatgcaactctcaagagtatttggctctactgatcactcctttgtagcactgtgttttaaaatataggttttattattatttaggtatggtgaggccaatatatcaggaaatgactgtcgttgaaaaaagtatgttgtactcacagatcccaagagaaggggggcacaccatgccacaaagggccacatggggaagcaccagggtcagccaggaggtgggtggggggtgcgcaagatctttattgtggtttcaacaggaagaaatgggtgaagcagggtgagtggatttaggattagctgatataaataatttcagcaggctctggggcataggggctgtccctagtcttctggtacttggccctggggtgattaaggcagttgcatagtgttgggaatgtgaaagcccccaataaatgaggcagttgtgggtatgggctctgaaatgggttggtttgcatttgaaaggtgtgctcatgggcaagtggtttactctctcttagaggttagaattggctaaccctgggagcggcagtcccttcagggtcagcaaggccccaggtgtcaaagcatcagaatacagaaaataaaatgcatggataatacacactgccatttgcctttgtacccttcctttcaatcttctctgctggtgaccgctcttcacaaagatctataaatgttggaataccccatgtctcagtccttgggcactctctttcctatctctctgtaggtgatgtaatgcagatatccatgactttaaatctttaacacttctgcattgatgactcctaaatttacatctctaccccaactgcctactaaacacctccacttggctatctaataggcatttcaaaccaaatctacaacaaacgtaactctttttccccttccttaatttgcttctcccccagccttctccattttaataaacagcatctccattgccttagtgactcaagccccaaacttaggaattttcccagatttccctctttttctcaaactatatatctagcctgtcagcagttcccttcaggtcttttttcaaactatagaaggcctaaacaaaggaaagacatgctgtattcatgaattggaagactaaatattattcagctggctgtattccccaaattgatctatggattcaatgcaatccctaccaaaattccagcttcctttgtctgcagaaatgagcaagttgaccctaaaattcatttgaaaatgtaaggaagcccgaatagccccctaaaaaaaaatcttgaaaaagactaacaaagttggaggactcacactttccagtttcaaaacttactacaaagctacagtaatcaacgctgtgtggtactgacataggatagacatatagttcaataaaacagaatcgagagtccagaaatacatccttatatatatgatcaattgatgttttgcaagggtgccaagacagttcaatagggaaagaataatttcctcaacaaattgtacaggcacaactgaatgcccacaatcagtagaacaaatttggaactaaagttcttatatttaggttcttgatccattttgtttaatttttgtatatggtatgaggtaaggctccaaatttgttcttttgcatgtggacatccagttgtccctgtacaattgctccatttatatttatcttagcagaaaatacagatgtaaatctttgtgaccttgactaggcaatggtttcttaggtattacacctaaagcacaaacaataaaagaaaaaagtagataaattggatttttttacttaaaatcaatttgtgtttcaaaattaaataaaatcaaaattaaattaaaacatttatccttcacaggattctataaagaaactgaaaagacaatgtgcagaatgggaaaaaatatttccaaatcatatatttgataaatagtttggcaattcctcaaaaagttaaatatagagttaccatttaattcagcaattctactcctacatatgtacccaagataattaaaagtatacatagacaaagacttgtatatgagttttcataggaactttattcataatagccaacaagcagaaacaatccaaatgaccatcaactgatgaatgggtaagcaaaatgtggtatatcatacaatggaatattatttagtcacaaaaaggaacgcagtgctgatatatgctacaatacagatgaaccttgacaacattatgttcggtgaaaaaagccagccacaaaagtccacatattgcttgattccatttttatgaaatatccagaataagcaattgatagagacagaaactagattagtggttgccaagggccatagggaaagggaaggggaaataggaagtttctgctaatgggtaaggggttccttttcagggtaatgaaaatgttctaaaattggataatagtgtttgttgcacaactccgtgaacatactaaaaaccacagagtcgtgcacttaaaaaaagtttgtgttttaaatatatatacacacttagacacatataaccctctttcgtatatcaattatactttaataaagctgttgaaatttttaaaataaaattttaaaacaaagaaaaaatatataaactcgccaacagaccacttctcacccctactagcccctctactctaagctatcagcatttctgcaaacacattcctaaccgatctcactgcttgtaatcttgccagcaacctctccctctcagcaatagtctattgcctacaccaaagcttagttgtctcttaatgatgtaaatgaggttctatcattctcctgacccaaaccctccactgcttttcatcacactcagagcagctctgctgttgcctgatttagatgtatggctccaacagatttcccctgaagaaatgattccatggctgataaaagttggaaagcctcctcagtttcagaccattatcagattagctgtgtgctctgtccctttcctcaaccataagaagtccatggataaagaaagcttcagagtaaaggagaaagcatgggaggtacagcaggaccaaggtggggcattcgcagcccccaccctcatcagagccagttccctactctccctgtctaaacctcttagtaagaggtagttcaagagaggggcaaactcaattccagcactcaaaagcacttgactactttgctcagtcaactagcaagtatttattgagaatgtagctctgttctatggagtcttattttcaagtgtcagactcccagacatccagtccaggtaaagaagatggtgtccattattcatttgacaaacaaagttggggttcaagggccagctattgaaaaaagctatggaaagcttcatgagacgtgcaggtaactgccaatatgtgtggttcacaaggactggttcatattcagaaacggccattagaaaaggaagaagaacttctcatttggatttataaagagtgtcttgtttactcttaatttatatcttctcttctccaggaaatcaacctataacttctcctcccagctccactctaccatggtctgtcaccttccccaaatgatttgttattcccctgttttcaaaagtgaacaaagaaccaaagacccagcaaagtttcacaaggccctgagactttcaattgtctatttcagatcaaatacagaacatgatcttcctcctgctaatgttgagcctggaattgcagcttcaccagatagcaggtaagaaaggacaaagggagaggcttaagaaagaagagcaggtggtggttcctagccaaagccaaaaatgagaatgtggccctcaggctgagggctttctttgagaggacgtatgatttctgggctattccaagcaccacaaaaaaaaaaagagtccccatggtggcttatacatgccaatgtccctatctgacagaaacggtgactgagaatattgctccatctattcccactatccagtgagggtaatgacaagaagacaggatcactcagaccatgtaaatctaaactgatacaagagggcaggggttgagttcccttaaaggtgagatgccaagcagctgtccccttcctttctggcagggagagtaaggagacaatggccagggaacaccgttactctaaagataatgtcttgaagacattctgcatattattagttgtttctgtgagtttcttttttgaaaagcaacaatagcagccgttggtcattcataccttaatgtggtttactgagtcttcctaaaacccaaatgaacaatgaaccttaaggctatccctttggacttgaagaaaggacttctattggaggatgagggtgagcagaaagaaaagcagtttcacagttggttgttctcctggggaaggtagttcagaccattcgagggtgtagttagaaccatgagtgcactattttggatgaacaccaggagctaagagagtaacatagaggtgtggacagaggattaagtcctcaagacaatagccccagccccatgggaaatcatctttctgctcatgattgagaaataatggctcccttggcacttgataacctttcgaagagctttctcctccctactagctggttccagatcactcttcacccagtcacattcctctcactcacttgagctgcccagcctggtctggcactagagacatgcacttggggccctcctcaaaggaagaccctgagatattctgcttacttctactctgctcctgcctgcagggccagctaaaggaacttttcatgttttctttgcaaggaaccctgcctggctggcattttagagacaagcaaaaggggcaataacttccttgctacaaaacagcttcaagtttccatagagtgataagggaaatgagggccaaaagacactgttccccatcctgtggcaggactgggggcttcaggagaaaacttggggaatgtgtaacctctgtgggtttgtagcttaaaaacactgagatcctgggttttctgtctttgttttttgccttttctcttaggaaaggagtgagctagggtgacaaggggcaacattttttatccctcattggctctttctacagaggaaggatcttttcttctaagataatcagcacaagacaatgaagataggcactagctcccagttaggtatactaatggggcaaaaggaagagcatttacatttattgaagattcactaaatgccagatactgtgctaggcaatttacatatggtatagttcatttaatcttcacaatgatcattttgcaggtgagggaactagaactcagaaaaggtacttaatttccccaagattacatagttattaggtgacaccggcaagatttcaacaaagctaatgtcctttctactttactgtgctaccatgatgatggtaatcaaaaatggcagacaacccataaatcttccaactttggaataggtttttgcactgaagtctgaatatggatacgtattgaatgtttattctggatattcacagaatcaaaaaatatgtgtaatgaattatgttgctgaattaactgaaaggaaagtaaaaatgtagcgctttctcattttcttcacgaatttggaattcttttctgctttccactatgcagataacatcagttcagacaaatattaaatacctacctaaattagaatgccttctcctcatgggatttttttaaaatcttgtcatttcatgtctctttaattaaagagttttgatttcagaggagggtacctgcaaaagaaaacaacaaaaaaactaaaggatctgagaaataattagtgtttacttctggggaggggaggaggtctgggatgggggtaaaaaggatagtcttatctattatgtatattcaggtttttgttttttacaagaagcatgtattaggtattatttgtataataaaatataattttaaaaatacaagaaatttctcatataaaaatatgaaagtaatcagactgcaacactcagtgcctgagacagagctacagctatcagggtgtccagacagacagaagattacattttcttccttgctccttgtacagccccagacctgcatgcttcattgaaaagaaaagaagatacctgaattaaatcaatgtgatgcttagtaccctatcagtgcacatttcttttctatttttaaattttaaaaataacacttggccaggcgcagtggctcacgcctataatcccagccctatgggaggccgaggcgggtggatcacctcaggtcaggagttcgagaccagcctggccaacatggtgaaacccctctgtactaaaaatagaaaaatattagccgggcatggtggtggccacctataatccaagctactcagctgaggcagaaaaattgcttgaacccaggaggcagaggttgcagtgagctaagatcatgtcactgtattccagcctgggtgacagagtgagattccatttaaaaaaaaaaaaaaagaaaaaaaaacacttatggcggtattctcagtcattacaaataaataaaaacaatccatatgccctggagaatttgattccaggagtaggtctagaagaacttcaactggagaatggatagagaaatcatggtatatttgcagaatatatattatatatataatagatagcatgtgaataaattaattacaaaaacatatgactacatctattattatatagcatgtagataaattacaaaaacatgtaactacatctatgaatcttagagcataatattgagtaaaaaataaataaataaaaattaaggccagaagataacacatagcacaatgtccttttcataaataaatatattgcttaagcataccttatatatagaagataaagcttaaaaagtaaagaagaggccgggcgtggtggctcacgcctgtaatcccagcactttgggaggccaaggtgggcagatcacgaggtcaggagaccgagaccagcctggcccgcatggtgaaacctcgtctctacaaaaaatacaaaaattagctgggcatggtggcacaagcctgtaatcccagctactcgggagtctgaggcaggagaatcgcttgaaccagggagtcggaggtggcggtgagccaagatcacgccactgcactctagcctgggcgacagagtgagactccgtctcaaaaaaaaaaaaaaaaaaagtaaggaagagactgataagcccgatattcaggacgccagttacctctggtgcaggcagacatacatcattagtaatgtgctagttcttagggtaggtggtaggttcacagatgttcattttacttaattaaatatattttgaaaatttatttaaagctttctgttgtaaaatatatcacagagaaaaccacatgaaacaactataaagcttaacattactataaggtgattacttttgtaaccaccacccaggttaagaagaactttgtcagctccccagaaatgcttcacataccctagcccaataaaacctcctttgcaaatactcttcatagcactatctgatatgccctttatttttaccttttttaaattaaaacaaaactttttagagacagggtcttcctctgtcatccatgctggagtgcagtggcccaaccacagctcactgcagcctccaactcccaggctcaagtgagtctcctgcctcaatctcctgagtagctaggactacaggcatgtaccacccggtctggctaattttttaaacatttttagtgatggggtcttgctatgttacacaggctggcctcaaacgcctcgtctcaagcaatcctcctgccccagcctcccaaagcactgagatcacaggtgtgagccatcactctcagcctgccctttattttttcatgaaagaaattgctgaagaggactaaaagaagttttagtaagcattcaataaatgtatgttctttatagtttccaaatcagcaaatatagacatcctgcatttttaaggagatttatatattttattggacatgctgtaatttatttaaccacttccctgttggtagacattatttccattttcttctgctagattaatgcttgaaaaaaatgtgtgcctcctaaagactgtgatgaaagttgcctctgaataaaactcaaacaaatcattaatcattaactctttccttacttgtatgctctttggatgctctactgtgttatctataaaataaagtttgaagtgaaaaattagggtaaaacattttatatcatttttaaaggatatatacatggatgtacttacatatgcatgtttaaatttatataccataacatttattctttttttaaaaaagtcttatgaattttaacaaatgcatagtcctataactaccaccaccacagtgaacatccaggacagttccatcccttgccaaacaaacaaacaaacaaaaagcttcacccaagtcttaagtccaggcacttactgatctattttctgtccttatagtaatgacttttccagaatgtcatataaatgggatcattcattagatatccttttgtatctggcttctttcacttaacataaagcatttgaaattcattcatattgttgtgtgaatcaataatttatacctgtttgctgttgagtatattctagtgtatgtatactatattttgtttataaattccccaattggggcacatttgggtatttcccattttgggtgattacaaataaagttattataaatatttgcatataggtttttttgggcaaacctaggttttcatttcacttggataaatacctagaagtgggattgctaggtcacatggtaagtgtatggtttattgtgagaaactgccaaacctttccatagtggctgtaccattttttcattcccaccagcaagtatatgagagttctaattgttcctcatccttcccagcactggtattcttttctattttttctttttttttgagacagagtttcgctctgtcacccaggctaaagtgcaatgccgtgatcttggcttactgcaacctccgcctcccgggttcaggctattctcctgcctcagcctcccaagtagctgggattacaggcacccaccaccatgcccttcttttgttttgtatttttaatagagacggggttttgccatattgaccaggctggtcttgaactcctgacctcaggtgatccacccaccttggcctcccaaaatgctgggattacaggcatgagccaccacgccctgctcttttcttaagtcattctaataggtgtgtagaagtggttctaacttgcattttcctaatgactaatgatattaagtatacatatatttatatattattttataatcttatatataatatacatattttatatattatatatatattttatatatatatacacacacacacacatatttttttctttttttgagacagggtatcactctgttgcccagattggaatacagtggtataatcatagctcactgcagcctcgatctctcaggctcaagcgattctcccacctcagactctgtagtaactgggactacaggccatgccaccatgcctggctaattttttttttttaattttgtagacatggggtctccttgtgtttcccaggccagtctcaaactcctggactcaagccatcttctcgcctcagcctcccaaaatgctgggattacaggcataagccactgcacctggccttagttaagtttttatgtacttattgtatatcttcattggtgacattcaaatcatttcatcctttgtaattgtatactaaggaattaaacgattgtttaattattgtttattttcttattgtaaggttttaaaaattctctatttttttgagacgcagtctccatcagtcgcccaggctggagttcactgtcgtggctcactacagcctctgcctcccaagtttaagcgattctccagcctcagcctcttgactggctggaattacaggcatgtaccaccatgcttggcttatgtttgtattttcagtagagtcggggtttcactatgttggccaggctgtctcaagcttctgacctcaagtggcccacccaccttggcctcccaaagtgctgggattacaggtgtgagccactgccacgaccttaagagttctttattctagatacaagttctttatcagatattgattttcaaatattcttttgaagtctgtagcttgtcttttcattttcttaactgtgtcttttgcagagcaaagattttaattttgatgaagtttgatttatcaatgttttcttttatggatcatgcttttggtatcatatccaaaaactctttacataacccaagatgtaaaagattgtcttctatattttcttctacacattttgtagttgtatattctatatgtaaggtttataatccattttaatttttatataaggtgtgatgtataggttaagctcattttagttttacatgtagatgttcagttgttccagccccatttgttaaaaaacacccatcctttccccattcaatagcctttgaatcttcatcaaaatcaattagtcatatttatgtgggtctatttctggactttttgttccattaacttatgtgtatatccttttgcaaatatcacacttatatttgttttttttcttacatttttatttcaaaatctaaggacatcttataacccagaaatattttttataccttgtcatgtcttagaggaaagagccaccccagtcttttttcattgatgtttttcttctctcttcgtactccagaggtagatgaaaaccagagggccacaatgaccatggtgatgcctgaggtcattctggggcacagacctcagcctaggttactccacttcgcctatctttagatccaaaactaccctgctgactgctgagataaacaaaggagaataatcaggttggggaaaggatttctatgcgaagacatgtctccatgcagtcctcctacactgagcagagcatgagtcaggtgcttagagcaggattttgtcctaaaccaggaacttcagagttttctgaagaatgtggctatgtaaagcacccccccaccccacccttacttctcaagtacattacgtggcaagtctgaaaaaacttacacttctgttgttaaatgtgggggataaaatataaacttagtttcaagaggaagctatcttgggaggtaatgcaaataattcgttgtgtgtttcctgaataagtgacaggtgctgactaccattgatgcttcattgcaataaaatgcaaagctcccccaagaatttttgaaatgcatcaagctaggtgttctaatctagcaaaaggacctgcatacatgaatttttcatgcttttgccaagtcttttgccctttagtttagttaagggccccacatgaatggaaagcctgtgttgtcagcttaattttgtagttgtggaaaccttccagttttctcctttgtctaataccttcaggagttcaatcctaggttgaagcttaatttaataaccatgtggcatgtaaagtagaaaacaaaacatcttttccttagcatacagcaaaaaaaaaaaaaaaactcactcatggatgtagtgtacacatgccagtggatatatagtcataactgcagtcattggtagcacagaaataaatgtgcattgaagacacagagatgaatttgaattccggttccatgagctaccattctttgaccttgggcaagttgcatcacttctttgagcctcagtttccccatctgtaaaatgtggatagcaacatctacctcgcagagttgctgggaggatcagatgaaatgatgggctagcccagtgtctgacttactgtgtttaagaaatatcaactattacgctacttcccagtgacagtccaaatgcagaccagtgttataactctacttctcaaacattaatgtgcatgcaaatcaccgtgaccttcttaaaatgcagatcctgattccctaggtctggggaaggcttgaaattctacatttctacctagcttccaggtgaagttgaggacaacactttgaaggcaaggtggtaaaagacgcttgcacgtgcaaatgttactttgtgtaactaatggttcgcaatactgtctgcactttagaagctcccaggaaaagaaaatctttaatgatgctgacctcatctccaaaataatgtaattttaacagatccaaagtagtgcctgggcattagtgtgttttaaaagcctcccaggtgattccaatgttagccaagattgaggccctctgcttagtgaatctaatttgcagctgggcttgagaaaaaacctcttcatagaattgtttgcatcagtgtcttgattgcctctgtaacttacaataagcaagaatgtttcaggatttcaaaaatctattgcattgcctaaacctcttattttgtatggagtaatcaagctcaaagtttgcatgtcttagaaactttacttggggcaaaattagaccaagtaacaattaatcttctaggtattctgagctattcagacatatgattcatgtttgctaattgctcttttctcttgtaaatattagctgaaaaatgtcacctgtctgacaagtagcatattttatgcctatcactcctggcacgcattcttacaaggcagacaggaaaaataggaagaaaatggacttttatcaaaggcccaggcagtaaagaggggagttctgctgtaagctaaggggagttccagaggaagttataggcgttccctttcttatgacaagaaagcatagtgcagtaaataaatttgctaaatagattcaacagtctctacccaaagtcatctatttaattcttgttgttatgcagactcagcaactaaccttccttgtaagccccattttcttccctgtttcctgtttatcaaatgtaattaaacaagagaagtattatagaagagtaaaagtagtaggtaattcttgaacttggcatatgattactacatatttgatgaatagttgaatattattcttcaaggacagattggatttggtatcaggtggctctgcattaagttataagggacttaataactcaagtatttaaggacggcttccatcataaagggatctgcccttaagagggtcccattatggagattctgaggtgagagctattccaagtgtgcagtggattaaaataaaagaatcatacaggaaatctctttttacatgccttattccagggtctttgcaacctggcacagcaagtgcagatatgattagcattgttttacacatgtacactcaccttatagccctgcccctgtgcccctcctgcacaaaagaatgctgggcacacgtgaactcctctctgtagaaaggcacattaatgttctagccatggttaaaacagggatagaggcaagccaaaaatgtcggtcatttgaaataaatctcaagtttgtgcatatcactatcaagtgtgctgtgtggcaattaagaatgccaatttgtgtgatcacaggcaagttgcagtttgatgaaaggaaagcagaggtgaatatataaccagggtcatcctttctttctccctctctctctttctgtcatttatttgccaagctcttaactagaacttgctatgtgctaggtactggatatatcaaagcaaactcagcctggtctttgccttcaaagatttgcaggatagtgggaagaaaaacttgaatcagaggacatctgcagtgggaatcattcaagcagcagaaaacccaaaagttacttatactgtgaaatctgatcagagaatggactgtcctggttagtaaaatatcctggaggataaagattggccatgcattccacatatgaattaccactttcccaagaattaaaacatggtacgaaagaaaggaacgaacatttgctgagtgcctactgcctgccagatctaggcacttcacatgtaacacctcgtccagcctccaccacaatactgagaggtagagttcaacctcattttatagataaagaggctgaagctcataaagattaaaggacggactcacagtcaaaggactcctaatcctgagtcagcatttgaacccaggctcacctgtcactatatcctatgctcttccgtatcacattttatactgaaacaacttctggaatagctaatgcttagaagcagctcccaaatatttgttgaatgaatgatttgattgaatgaatgaataaatgaatgaagcaagctctactgaacataatttgatctaatcttctgtgattattcagaaactacttcaagattttcctatacctccatcataatgaatacccattcattaatgatggaagcagcctaattttgtcatttttcacactttattgatgtaacactacctttactagtttggccactccttatgctttttttatagaactatttagatcaattcaacttttaaaaaataaagccacatacccctgtggtagatgaaaaacaagtatcatttgcactggtaaatagagaataggaagaaaaataaatgcagtgaaaataaagcagtgttatcaaatcctacccagatactgttatctacccggaagcttcctgtttgattaaaaggaaaaatagccagtgttagaggtgtggaagtctagttgaaattatatgcaattgaaggattaaaatagaattgaaaagggaataaattcctctctgaataatttaactccctttaggctttgattctgcctcatctaaaatcatcttacatacttctagtggcgtgtccctcacattttggtaaactctgagtggaaactacggattttgtagtcaaacatctgactggctctggattttaactttactaacatatgtcctgaagtgaactgcttggagccagtttcctcaactatataaccataatgacaaaacaggtttcacggtcatgttttcagtattaaacaatatagttaaaagtacctagcacagtgcctggcatagaacatactagatatacattaagtatcagttccatttttcctttccctttattgtcagaaaatagaaagcatctacagtgggcttgtatgatgtggtggttagaaatacctgatctgattctggctgtgcaatcttgggcaagttacttaacctttttgtgcctcatttttgttttctgaaaaaaaggatagaatattattacctaccttgctggcttctgggaagaagctcagtgagacgatgtgttagcagagtgtctgacaattgtaagaattcaacaagtaatagttattattaccatcactggtgagaggaagtgatacctggcacaaaaatatatggattaatcaatatggattgagggaaacaaacctggagaataggatgtgaaggtatttaagtaacatgagctcagaccttgatggtagggaagtcgaaaggaagcattttgttcttatatgacagatgacctggaatgactgcagggcttggggggtcagggactggaggtgggagaggcctctgagagcaagcagtgctgtccaccagaagctcttgctggggtgcccagagaggagcaaagggcagtcagctgcacaggagggaatgtttggaggagagagccacctcagatcagcgggtcaagaatcccactcttgcccagatggatggggcaaaggagaaaaaggattcgccacgggaatgtccagataagacaggtgccttttggaaaatgggggtgagatgggtctcaggttacacttcgtaagaactggaatgtaaagtaaaggcagacaatgacaaaatatcttgttttcttttcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaaggtgagtggtgtcaaggactagaatccatggaagcatctctccaacagaggatctgcaagtcacagaaacccattaaaggtagctcaagcaaaaacaagcaggctgcttttaaggagacagctatttcagagaaaatgaaagcatctgctcggaaataatttttgacatctgagtacaaagcagccgaagtacaagtgaaagggggtaggacctataggaataaaatgggactggaggaagccaggaaaattagtccctgaaatgtgggagggtatgaaaaataagctttgcctaattcacaattctcccatggaacatccctgacttgattattaagatactctttttcaatagtttataccctgaatccagagtttttaaaaccatggtttgccgcccattcatggattaaaatatcaatttagtgagtagcaaccagatgcacgtttcccgccctttaaaaaataatgtatagaagagaatagacagagtagatcagacgacatcacagagtaggactgagtactgtaaaactaatttctgagggacgtgtgtgtgtgtgtgcgtgttgggtcatggtataaattttttttttcttactttggatcataaaaagttacaagtttggaaaacactgctcaaatgcaagccctatttattgcagatgaagtagctgagatccagagaagggaagtgggtagcccaagagagtcccatgaagtctatagctgtccctattcctctggattcagggatctctccactccagcacaattgaaaatctaaatataaagagaatcttcacactcttgtttgttctagaaaaggtgatttgaggaaagacatataacaactataaaaaatagattttgcttgttcattggcttatggtctccaggcttgaatgctctgagataaatgatgccaatatttctctggcctcttcccctcccacgcattggacctcagatggtctgtactgtcttctagagggtttgtgggttttggccccaaaaaaccattaaccttggcagaaagtgtgtgactttatgatctggtacaaagaaggacaaactagagggactggacatgaggatgaatattgtgttcgcccttatccttgggcaggttattttgcctttcataacctcacattttgcttatttgtagaagacgaacaatagtagtaccaaacacacaggattgttgtcaacattgagagagataatgaacataaagaactgagcatggtacccggcatataataagtgtccagagacttggttaaaagaccctcagttgttacaggggcagtgacctcctcacacctcaaccatcaatgagtcaccaggaaagccattagcctagatgtaactgttttctatctttattgcatttcctacatccaggcagcagctgggaggaactctagaacactgaagtttgtctgagttcccttaatgtaaggctgtacattctcaggatgccttgatgtactcgaatatctgcaaccctaaatcaccacctctgtttttattgatctctatctgaatgctgtattaatgggccaggccttctgcccattctctcaaactgagaactgtctctcattcctggggaggcaccctgcctactccttacctagatcagggatttctcagttgtggagagatttgttccttatagtgttggtcatcaaactgggatatttggggattacaaagacttttcaagggatgtatgggcacaggcagttttaggaagtgagttcctagatcctcatcttccccaaatactcgttcccaaaattgacgagcctgacaatgtgcatgccaggcaaggctcttggggttcccctaaaacacttcctcttttaagcctaccactcactcatcatgaatatagtccattgtcccagggtgtaaaaccctctatagtgttaaataaaagaatgattgggaacattgacacctgatggaactgttatgactaaaaacccttttgcaaataatgtggtatctaattttctgctttcaacaaaattgaaggaggcccttataaagttaataactgataatcaaaaatgagtaatttttgccatgtaaatcaggtcaaagaatgaaatggcattgctgtaacgaaactgcttccattcccattgatttactcatacgaacaagattccttagcctttataagctacaaaaaaatgaaaaatagaaatagaattgaggctgaattctattatataaaatcattccaaccatgtcatatggttcttcggattcatgaataatttggaaaagagagccatatccatcttattaagggacacattcccaataaattttcatctttcatgtttaataattatcaatattcataacattttacattttgatcaaatatgtgttaataataatagaaataaatgtccaacaacgatagactggattaagaaaatgtggcacgtatacaccatagaatactatgcagccataaaaaatgatgagttcatgtccttcgtagggacatggatgaagctggaaaccatcattctcagcaaactatcccaaggacaaaaaaccaaacaccgcatgttctcactcataggtgggaattgaacaatgagaacacatggacacagggaggggaacatcacacactggggactgttgtgtggtcgggggaggggagagggatagcattaggagatatacctaatgtttaatgacaagttaatgggtgcagcacaccaatatggcacatgtatacatatgtaacaaacctgcacgttgtgcacatgtaccctaaaacttactgttaaaaaaaaaaattagatcttaatgcagaacaccctgaacatttaaagcttcatagtcacaagagaaaagttttcatttcaatagctataaatattttgttgttgtaaagacatataacgataatcaatacaaaatctgtcaaacaaaaatatgttacattaagataaaattctgtagggaaggtgaaattggaagtgagtttcaatgaatgaaaagaaacaatttagacagagaagaattttttcatttaataatttatttatttttacttagaaggaattgaatagattaggttccttacccaaaaagcctctgttatttgtcttatttatttattctcttttttccacattctccagtctcattccccttttttaacacaggaaattattccagcatgtttcatacatattcttttgtttgtaagagcttatttaaaatatgtaatattgttttagatgcatatattttttttcttgtggaaactatattgtactatatatatatattttagaaatggacacattaggccgggcgcggtggctcacgaccgtaatcccagcactttgggaggccaaggcgggtggatcatgaggtcaggagatcgagaccatcctggctaacatggtgaaaccctgtctctactaaaaaatacaacaaaaattagccgggcgcggtggcgggcgcctgtagtcccagctactggggaggctgaggcaggagaatggcgttaagccgggaggcggagcttgtagtgagccgagatcgctccactgcactccagcctgggcgacagagcgagactctgtctcaaaaaaagaaaaaaaaaaaaaagaaattgacacattaagtttattgtgaaaacatgattacaagcaataacagatataacagcagaaaaaattgtgaagttatgtgcaccttcttttgagatcatttttttgggtatatgtgaatgtattttatctttttttaattgacaataattgtacttatttatgggatacatagtgatgtttcaatatatacaatgtatagtgatcagatcggggtaattagcatatttatcatctcaaatatttattatttctttgtgttgagaacattcaatgtaccccttctggctatttgaagctatatactgttgttaaatatttatatgtatttttcaaggataatgttgtatataaaagataacttcttttatatttagtcacctttggatacatatgtaagagtaaaataattgttttactaaaaaaattcataagatgctgaacattatatgtttttccagtatagaaacttatgaaaaattataagaatcaacttaataggtgagaagagcatactgcatcatacttattttaggaggaatacaagcaaaaaaaaagttggaccatcacctaagagtaggctaccctgatccagggtctctaaaagaagcaagatagatctgaggccccaatgagggttcccatgaatgaagtaggactagaagaaggacatgtttttatcttaaagtgcctgatccatggcataaagcttgaaaatgggtttgtttatagcaccttcgttgatgtctgggcagaaattcttatcaaatataatgaaaagagttaatttcaaaaggacagaacaaattatgaggtggaatgaccggagattctggaagagacagtgataaaggactgtggtttctgaaaagccaggtggcacctacatttctgggggcaatccatctgaggaaggggcgggagcatggccaaagaacagagaggccccaggagcccaggggtctctcagaggagctggggttgagaactggtctgtgcaaaggtttccagacagggttgcagaggaggcactaaaaacaagaacaccaagagccaaaccatcctgaaggcctgggcagggcagggggatgggaagagccaacaccaggaatgggctgaagctgacagaagtacttcaaaccagaaacaatgaatttaaactatgccctaccacaaatagacttaacagatatttacagaacattctacccaacaatcgcagaatatacattctattcatcagcatatggaacattctccaagatagactatatagtaggccacaaaacaagtctccataaatttaagaaaatcaaaattatatcaagtactctcttagatcacagtggagtaaaactggaaataaactccaaaaggaaccttcaaaaccatgcaattacatggaagttaaataatgagtgatcattgggtgaacaatgaaatcaagatagaaatttaaaaactctttgaactgaacgataatagtgacacaacctatcaaaactctgggatacagcaaaagcagtgctaagagaaacattcatagcattaaatgcctacatcaaaaagtctgaaagagcacaaataggcaatctaaggtcacacctcctggagctggagaaacaagaacaatccaaacccaaacccagcagaagaaaagaaattacaaagatcagggcagaactaaatgaaattgaaacaaaaaaaatacaaaagagaaatgaaacaaaaatctggttatttgaaaagataaataaaattgataaccaagaaaagaagagagaagatccaaataatctcaattagaaatgaaatggagatattactactcatatcacagaaatacaaaagattattcaaggccactatgaacacctttacacgtacaaactagaaaagctagaggagatggatacattcctggaaatatacaacccttcgattaaaccagaaagatataggaactataaacagatcaataacaagcagcaagattgaatggtaacttttaaaattgtcaacaaaaaaaaatccaggaccagacagattcatagctgaattctatcagacattcaaagaagaattggtaccaattctattgacactattccatgggatagagaaagagggaatcctccctaaatcattctatgaagccagtagcaccctaatacaaaaaccagggaaggacataacaaaaaaagaaaactacaggccagtatccctgatgaacatagatgtaaaaatcctcaacaaaatactagctaaccaaatccaacagcatatcaaaaagataatccaccatgatcaagtgggttttacaccagggatgcagggatggtttaacatccacaagttaataaatgtgatacaccacacaaacagaattaaaaacaaaaatcacatgatcatctcaatagattcagaaaaagcatttgacaaaatctaacatcctttatgattaaaaccctcagcaaaattagcacagaaggaacatatcttaaggtaataaaagctaactacgacaaacccacagccaacattatgctgaatggggaaaagttgaaagcattttccctgagaattggaacaagacaagacactttcaccacttttattcagcatagtactggaagtcctggccagagcactcaaagagaaagaaataaagggcatccaaattggtaaagaggaagtcaaactgttgctgtttgctgatgatatgatcatatacctagaaaaccctaaggattcatcttgaaagctcctagaactggtaaacaaattcagcaaagtttcaggatacaaaattaatgtacacaaatcagtagctctgctatacaccaacatcaaccaatagctgcaaaaataaaataaaatacttaggaatatacctaacgaaggacatgaaagacctctacaaggaaaactacaaatcactactgaaagaaatcacagatgacacaaacaaatggaaacacatcccatgttcatgaataggtacaatcaatattgtgaaaatgaccatactttgtagattgcaaaagcaatctacaaagtcaatgcaatccccatcaaaatactaccatcattcttcacaaaagtagaaaaagaaatcctaaaattcatatggaaccaaaaaagagcccacatagccaaagcaaggaagactaagcaaaaagaacaaacctggaggcatcacattgcctaacttcaaaccatactataacaccatagtcaccaaaacagcataatactagtataaaaataggcacatagaccaatggaacaaaacggagaacctaggaataaagccaaatacttatagccaactgatctttgacaaagcaaacaaaaacataaagtggggaaagtacatcctattcaacaaacggtgctgggataattggctagccacatggagaagaataaactggatcctcatatcttaccttataaaaaatcaactcaagatggatcaaagacttaaatctaagacctgaaaccataacgattctagaagataacatcgaaaaagcccttctagacattagcttaggcaaagacttcgtgaccaagaacccaaaagcaaatgcaacaaagacaaaggtaaatagataaatagggacttaattaaactaaaaagcttctgcacagcaaaagaaataatcagcagagttaacagacaacccacagagtgggagaaaatcttcacaatctatacatctgacaaaggactaatatccagaatctacaaggtatgcaaataaatcagcaagaaaaaaacaaacgatcccatcaaaaaatgggctaaggacatgaatagacaattctcacaaggagatacacaaatgaccaacgagcatatggaaaaatgctcaacatcactaattctcagggaaatgcaaatcaaaaccacactgcgataccaccttactcctgcaagaatggccataacaaaaaaataatagatgttggcatggatgtggtgaaaagaaacactcttacactgttggtgggaatgtaaactagtacaaccactatggaaaacagtgtggagattcctttaaaaactaaaagtagatctaccatttgatccagcaatcccactactaggtatttacccaaaggaaaagaagtcattatacaaaaaaaagatacttgcacacgcatttttatagcagcacaatttgcaattgcaaatatatggaaccagcccaaatgcccatcaatcagtgagtggataaagaaaatgtggtatatatattatacatacatatatatatgcatattatatatatacaccatggaatactacttagctatgaaaaggaatgaaatcatagcatttgcagcatcctggatggaattagagactattattctaagtgaagtaactcaggaatgtaaaaccaaacattgtatgctctcactcataagtgcgagctaagctatgaggatggaaaggcataagaatgatacaatggactttcaggacttaggggaaaggatggttgggggtgagagataaaaaactccacatttgggccaggcgtggttgctcacacctgtaatcccagcactttgggaggccgaggtgggcagatcacgaggtcaggagatcaagatcatcctggctaacacggtgaaaccccgtctctactaaaaatacaaaaaattagccgggcgtggtggcaggcacctgcagtcgcagctactcgggaggctgaggcaggagaatggcaggaacctgggaggcggattttgcaatgagcagaggtcgcaccactgcactccagcctgggcgacagagcgagactccgtctcaaaaaaaaaaaaaaaaaaaaaatggccttcaccctaagaaggaagaaaccaagggcagaggaaggaaacaatcaaagagaagcaaggcagcagtgaaaagacaactgtacgtttaagcctctaaggcccaaggaaagcatttgctaaaagagccaagtctcagtgtctttttttcccttggggaaacagaagggtgtaagaaaatcggagtcaagaaaatgtcctgagctccgcctgcagtagcgggaagcctaggagtaaaataacacgttttttaaaaataaagaaagaaattattttaaaaaagaaaacaatgtcctgaatttcaatggggtgggggggaggggaagctcctggggattacaaactcgttaacctgctattccttttcaggcaatttaacagatgaattgaaagcagtcctaaaagatttaactgattactagaaacttgcatagatcctctaagaccaaggcatgtaaaactacatttttccatttatttactgtcattatgactataaaacagatactaccatgtatacatttcatctttatttcagaaattacagcattgcttgtaacatatctgtcagacagccagaacaaaccagggaaacagaaaccatttaaacctgtggaaatctaaagctgaaactagtaattcttttaatgagggagactgagaagccaaacagagaacagggaagcaattcagaaattagcaatagcagaaagctgctcctaccactaggctatagtgaaaagggggaaggcagggttaatggagcccagggattaaagtcacttgacagacactggaacccagtgggcctgtccattggtatctggagccagggaagagatacatcttctgctggagaggccacaaaagtatagagcataggggagaaataccttcccttctccctccagtccaccctctagtgttcctgtcttgcttcctattggctgtcacgttcctaggctatacaggccacaggagtctgccttcctgcaacacagagcagagaagaaaaagtgagagatggatctgaaggcaaacagacccaggacacacaaagcacacacaccttgtgtattgggtggtaaaaggtgggataataatacagttgactagatctataacagactgaaaagctagtagttgttgagtcagggacaacgaaggctggctgatggcctcagtcaacttggagacaatctccaagtgctaaggggtctgttattcaggttgtaaggatatagccaacctaactgagcagcagatcatatatttagcaaaactgatcttatgaccttaggttacattaaaaccctggatatttgtgctgcttagataatatctagaatatagattgtgttacatatcctttttaaagaacgtggcaaaactaaactataaccaaagactactatctggaaatgggtctgaagactgtatcttgtgagatatagttaaaggaggtaggcatgttttacttagggttgaaaagactagatggagtcttcccagttatattcaaatatcagaagggttacctgcaataattgctaacactaattgagtgtttactacgttctagacatctaactaattatttaacacccttgttaaggataagtattgctgtatccatttcctaaacaagaaaactgagggtttaagaggtcatataactagcccttggctaaagcctactcaaactgctcagattctgaactcatgtttttaactacggtgcttaccatatgttgtgttactaaactagacaaataccaatgggtagaagctacaaagaggcacaattttgcttggcatgaagaaaatctttccaatggaagtttaacttgcttattgtataatcatggcaaagactgcttctagaggaagtaggagtttccattcatagatgttttcaggcaaaagttatttagcagtttactaatatcagaagaaaaatattactaaagataacaagggacacttcataatgataaaagagtgagttctaaaggaacacataacaatcctaaatgtgtgtccatttaacagtatagcttcaaaatattaaacaacaattggcagacttaggagaaccagtcaaatccacaattacatttgagatttcaactcatctctattacaactgatagaacaaacaattaagaaaatagaaaatctgaacaacacaattagccatcttgacctaatagacatatgatatatagaacatacacccagcaactacagaacacacattgttttcaagcgtatgtggaacaatcatcaaagcaattatctaggagaattgctgtagaaggtgtttttcattgagcaataagtcagatgacttgaatttttggagtacttccgcctcttaaattctaaaatttactcatcttttcctaagaatatcaccctcagtccagcttccccactgtgggaagcgattccttttccaccaccttccaaataagaaagaggctgtggagacatttctgatactgcaaaaatgtaggatgtgggctcctgtcccttccccaaaccttgctgattcttgtagtggaagagctctctctctgtctccctatctgctccctcatgtatcccaagtcaaagcctcagccaagctcccaattcctggcatccctacttctgaaatcacttctcaaccaggacaccaagatcagtttcttggtccaagccacctgcaatagtgggctggaccctcacccacagtactctgctcctgttcttgttctacttcattccccaaaagacttgagagcttacagaaataatctacagtatgatcatataaaatgattacaaaagacattgaaccaagggaaaataagtgtagataaataatacaaaatgagagataaagtgagtactcgaaatacacacttcgggtactgtttgattatgaaagataggccaaagttttggcttcaaggagattggtgagtctaacaggtcaagtccttcagtaggctgcttcagtgtctgaattgccttatcttctactactgctgggtgctcctaagaacctcagagcatattcctctatctgcttatgttgcaccatccctagacatctgcaattacacagagacacatcctcttatggtgattccaattaagaatgcattacaaaatagtaatatgaattttacccacctcatagggtctgcatatcatttaaatgacataatgtattatatgtattatgtatatttatacattagggggaaagatgtcagagctttttgggacataccaggaggcccagctgggtgtgctgaccacatggagacgagaacttcaagggagagccaaagtgcacgcaggttctggtggatgtttcattgtgcagtgaccctgctctctagtgaacccagatctagtgggtgttgtttgctataatgaatcaaattgtcaactcttaacattgagacccacaacacaggaggggaacagaggggcaaaaattgtgaagaacggcatgaacattccttctcttccataggatgtaaaaggacgtggcacaaagctcaacacatagaaaacaataagtaaatcatacacatcagatggttttcacatggttgttaccattattttaatgtgaaattgtttttcacaaagtttgtacctatttatacttccaacaatttaggagaaaaaagttgtatcacacctctgcctttacttcaagactacacttacttcaaaaattgtattgaaatttaatttcttaaaagaatatttcctaccgaatggaagccagtgctcatcccctcttcctctcaccaaatatcaacaggtgactttccacactgcctggtaactgcatatggtattgatatttgtttatttttagctattatctaagaccactggaaggtttgttcttgtgtcttctagtctcttggaatatcatgcctattttacttatttttaaagtttttataaggttgtaatgttttattttaattttaaaatttatttttaactggcaataatgtatatttatggggtacaatatgatgttttgatctatgtatagattatagaaagagtcaatcaagccgggcacagtggctcatgcctgtaatcccagcactttgggaggccaaggcaggtggatcacctgaggtcaggagttcaaaaccaggctgaccaacatggtgaaaccccatctctactgaaaatagaaaaaattagccaggcatggtggcaggtgcctgcaatcccagctactcaggaagctgaggcaggagaattgcttgaacctgggaggtggaggttgcagtgagccgagatcacgctgttgcactccagcctgggtgacgagcgaaactctgtctcaaaaaaaaaaaaaaaaaaaaagaataaatcaaactagttaacatatcacatcaccaagttgtttttttgtggtctttatttttttctcttcttaatctcaaaacagagaatgtaaaaaattcatgcttttagcaaatttgaatacagaatgcattaactgtggtcatcacacatggcaatagatcactaaaacatttcctctactctgagactgagcaacatcttccacatccccagcctctgataaccacctttctactctgtttctatgggatctacttttttagatttcacaaataaatgagatcatacattatctgtctttttgtgcctggcttacttaacttagcataatacccttcagttccatccatgttgtcatgaatgacagattttacttctttctaagggctgtaagtattccattgtgtatatataccacattttctttattcattctctgttgatggacatttagtttggttccacatcttggttattgtgaatcatgctgaaatgaataaaggaatacagatatctcttcaacatactaaattcaattcctttggatatatacccagaagtaggactgctggatcatgtggtcattctatttttagttttttgaggacctctatactattttccaaaatgactatacttagatctcagctttcttgaggcagggagccatatctgtttaattcactcagcatatactgcaaagaagcaggtgtgtgtatgaactgtgtgtgtttgtgtgtatgtatctgcatgtgttagggagaagtgcagaataaatatacccaactctttactatgtatagacattatctaggtctttattttttttctcttcttaatctcaaagaaaacagaggaaaggaggaagtaaaaagtaaatttttgcctgaagatgtttggaaaaaataccaaataaagtgagatagtgggtaatctagtgatttttatttttccgtcctctttctggcctccaattgtgaaataatttatagcactgtaagaaagaagccacaaattgtggtagcttggaccactgttgaggtctggaatcagaattccaatgttcaaatattggtcctaccagttataagctctatgactatgaacaaaacactcaacttctctatcttcagtaaccgtccacaagaattgggaatatcaacaatgccatctttattgcattgtaagaattaaataattcaatatatgtggaaaatagcatgatatcagggatatacaatgtgtttacaaatgataaccattattacttaatattgatagtgataattttattcatttcacatggcatgaagtaccaagctctataggaatcagaaaataaagtcttatttctttttcttctctattgtccagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtaagagctgcccccacttcctaggtctatcagttagggttcagacaagaaacagatggcatactcgagtgatttgaggagagtgtaataaagggactgtttacaaaggtgtgatcaccatttggagaaactacaaaggatagtgcagaacactggggcttcaatgttgggagggcaattaccactgttggagaagttactggaatcagaagggagctgtagggaaagccccacttcccaggagctgtagccacagaatagggaagctgccacatgcagcgactccaaagggtggaaactggatgaatgaataccccaactcattctcctcccaccctccaatctcctgctagcacctcccattggctgaacccagctagaagtcagagaatacaagggtccactgttgtattccataaaagtcaacttctcagggctcagagcaatattgacatgtacagaatagatctggagaggaaacagaaaatatctagtacaatagctaatcactgtgattcatgcacagtgtcatgagccagcaggatgaatattcctttgctgtacttgctgccagtcagctggttatgggtttttccaagaaatttggtctctaacaaaattcttcagagcctttactgactatgctggatatttttggaagggatcccatacttttgaacttcatacagcagaatttcaaacaatcttgggaaaataacaacttttatctgcccagtaaggacaactaacacctagtatcataatcatttcgtaagagacaggtaatttcatcaccgagtgcatatgttttctaatgctcttatatcaaattaccacaagcttcacagtttaagacaacacagatttattatctgatacttatggaggtcagaaagccagacttgagtttcactgggctcaaatcaaggtgtcagcaggattgcagaggccctaagggaagattccactttcctgtcttttccagctgctagaggccacctgcattaattgcctcatggcccctccctctatcttcagaggcagcaaccctatcattcagccttctgcttctgtcaccacatctctctctctctcttttttttttttgagatgaagtcttattctgccccccaggctggaatgcagtggcacgatcccggctcactgcaacccctgcctcccgggttcaagctattctcctgtctcagcctcctgagtagctgggattacaggcacatgccaacatgcctggctaatttttgtatttttagtagagatgggtttcaccatgttggccaggctggtctcaaactcctgacctcaggtgatccgcccgcctcagcctcccaaattgctaggattacaggcgtgagccatcatgatcagccacatctctttccctaactagcttgcttctctttgccacctcttaaggacccttgtgattgcattaggtactccatccccctggttatttggggtgatcttcccatctcaaggtccatcttcaaaattccttttgccatgtaaggtgacatattcacatgttccagggattagaatatggacatctttggggagagccataattttatttatcctactgagaagggatatactctcagactaaaggacagtccctagtactgattcaatctggctttatagaaaattcactatattgtcattgtatttcacagtttgccctttgtcttagctggtaagacagagcctatgataaggacttgtgtggcatgcaggtatttaattggcaaccccagagggcagaagcaagagatttaggagtttaagagagggtaatataagagtatattatcaaagttgtagtgtggacaacagaaactcaaatattcaaggaccagcatgtagacagcctcctaagatgtctactcagacaaagaatttcaggtggaaggacttgttcatctgcttcacgcccattggttgacaggaatatgaactccattctgctgctgggctagacatgcatgtgggctgagtgagctttccccagtatccgtagcatcagaaaagtcgcagggcagaaagaaaagtatccaatttgaggtgaattactgaccttgaagtgagtgtaagcctaactagaattctaccccagctggctgaagtgaaaggtgaggctgagaggaaataaggcaggactgcacagtccccaattgtactgttcaaatccactcatgcccttcattaagtcagctctgccactgagccttccagctgggaggcagccacaatctctgcagaagatttaatatacaccagtttgtggaacaagctgtagttcctgctgctgctgtggatcccaagccacagttgatatttgttgtctcactcatccaccatacattccagatttccctcacctaacaccccagatggaatggtttctttgcctgatagggtgacccagacttaacgaccctaagagatctgagcttttgatcagcatgcccttaacagactggggttgttgcaaatatcttttcattatcactggatatggaagtaaaaagaaccagtgaatcagcggacccctgagttccagacatactcttccttgtctccattatgtagcagtgttcaagattttcatgataatcaagattgatttctccaccagtatggtaatttttttctttgctcactggtctgccaatattaagagctcaaggtggccaggccagtagcagagctttagatgcagtagaacaagcagagtatcccctgctagaattccccgtaggaagccagacctttgattcagcagagcctaaatgtgtggggttgagtgaacttctatacgtgagtcattagaagtaatggtgagaggggccaacctgcagcactgggatagccctggtacagacgtagaacatgcttgaggaggttgtcaggaggaaatgagttagaccttgcacagaactaccaccatcaagtacagttggggtgaggcagacatggtatgagttgaggcatcagagatatctgatgctttatgccaaattaaaattaattttttcatggagtgacactgatccacagaccagactccaagaactttgcagtgactaaatacccatctcatcataactttcctggtattttcttctggaaaaaattcttccctgatacagttttcagaggcagctagatgcactgtcatctctccccttttcccacttccctacctatccacaatttactacccaatgccaacactaaagttagcccaacttccttctaactaaattattagtttagaaggaaagagaggagtcatgctaaggatcttaactgaaatcaaaacattagaggctgggcatggtggttcttgtctgtaatcccagcactttgggaggccaaggcaggaggatcacttgagcccagtagattgaggttacagtgagctacaattgtgccattgtactccactccagcctgggcaaccgagtgagactctgtctccaaaaaagaaaaggaaaggggagaggaggggagaggaggtagggaggggaaagaaagaaactagaaatccatcaattttaggaccaacttcaggtaaaaaaatgaattaggcaagttggtctttcaacattctctacctctctttatatcatggttgagaccacagacttctcacctcatgaaagatgaactctaactaattcatactaaagctaaagcctctaaagaggattaaatatgagcaatcccacgagaacttttttcccctggaattgtttattcaactgtcgttcgttatatggaatttcctgcctggttaagtgtaggccagtactttggatgaattgtagttttctagaaagacgcttcttatataagaacctctccagggaaacaggggcctgtatgagatgaattgagaaataactttacaccactgattatgtcagtgttctattctgcatggtagagatgtgaaagggcagactgaccattgctctggaagcctttacgctgtgagaagttaacagtggagtaaaatggccactccactctcttcatggaagccaacatggcttactaaatagtcaacaaccatgggagagacctgtggggtcttcatcagagctcaggatctcctagggtatcactcataaatacagccatcagggagatggagaaatctttgtgcagccagaaattctcaacctggttttacccatccttcccaactttgtattcgtcctactgtttactgacatggatcctctgcttcattaaccatcccttcctcaccacatgctctctgaacttggctgcaccttttctacctccatgccttctttgctcaggtttttccacataaatatcattatttccctctctactagctccaagcccaccctctctctggggcagctcagtcactccagggcacaagggggtctttccctcatcccacattttgagacctactacctggaccatttgtttgccttgtaactatgcttgcctttttaattgctattttattttccatgtattttcattgttcacacaagtcttctttattccacactaaggcaaaagcagagtcctgtgttcataataagtgctcaacaaatgttgggttgattgggttggagattccatcttagataatcgcagtcccatcatgccagctaccagactgtgtggacagccaggtcagagcagccaaatgatattctagcttgtggcacaaataccagcaacaaaataaccaaagtcacacatctgcctctgagttcctggcttctatttctcaagggcatttttaagttgtcttatgactgttccctttctactcattctcataaattgagctgtggactgctgtgacccacaagcttctccggaagtcaatgtataaaacaaacacggaaacgaagagtatggtgggtggagggtactccactgactctagaatggatgactgaacattccaaatttcaagcacaagttagggagcaacagatcattttccttttgaaatagggtttcttctgctcagccagttgttgtattttcattaggaaatggaatgggactacagcacaaaaaataaatataaaaggacccttgtagggctggcagaaaagagaatccttcctaggagacctggaggtgattccaggcagtggttgagagcatgggctctgatgtcagacaggcttaaatttcaaactctctctctattagctttgagaacctaaatatcctacttagccactctagcactcagtctctcatgtgtagcatgagggtgagtagtggtagacagtttatagggttatagtgaggattaaatgaaatgtgcttataaagtgcttagtactcagaaagtgtgcaaacagtaaaaaaaaatggtatatctagcaagttgcatgccttacttgtgagttcatgaagttgtggcaaggataagacaaatattttttgccattgcatcattatatcattgctaagagtatgccattattggccaggtgcggtggctcatgcctgtaatcctagcactttgggaggctgagatgggtggattgcttgaggccaggagttcaaaaatcagcctggctaacatggtgaaaccccgtctctactaaaaatacaaaaaattagccaggcatggtggcaggtgcctgtaatcccagctactcaagaggccgaggcaggagaatcacttgaacccaggaggcggaggttgcagtgagccaagatcatgccactgcactccagcctgggcaacaagagggaaactccttctcaaataaataaattaattaattaaattaaagaaacgacaaaagagtatgcaagaattttaaaacaacttagaggaatatgtatgaggatacaggctaagctaccataatgaagagacctcgaaatacagtgagaagcgagacagaagtatctttcgttccatgtaacactcaggtggttcagagcagctaagcagctatgttccatagagtcattcagtgatccagattattttcatctgttgctctgccattctccaggatgttgtccctataaaattgtcaaagctcagtcagtgccaaacccatgtttcaaccttcagaaagtaaacgagtggtggaaaacacattcaatgttttaaggccaagaccttgaaaactcactctcttagcctgaacttagattacatggctgggcccacttaactataggggaggcttggaaacatagtctctgagaagccatgtgtccagctaattccctaatactaaagttgaaagaaagaatggattaaccagcagtataccacaaggtaacaaatgactaggaggatcaggctaggtggactagaaaagagacagtcaattcagtgcaacaattccatattgacacttttcatgtagctgttgcttggctctatctagagaggactcagaggtagtttagataaggcctttgccctccaaatacagtctaagcagactgatttcctactggatgttcaactttggagtcttcagggatgagtagggcttctgtacgtggaagagactatgagggaacctgcacaggacaagggtttgcataaagacactgaggtagggacctctcctgttgtggggacagtgagaggcccaggtctccttgactcacaaagtgcttactaagcacttactagaaattaagaagcagattataatcaatatgggttatccaatgtttggatgagcaaggctccttatcttttcttcgttaatgttaatcacactcttttggatggagacaaatatctgtgggggctgagctttgggtcagatagatctgggtttgcaatcctggcattgacttttacttagcagtgatgacctcacatagattatttagcaactctgagacttacttcctcaactctaaaatgaggggctcagactaaataatgtctaatctcttctccagtaaaacaatccgtggttctcagatagcactgtgctggaggtagtggggtttgagggctgggaagttgggaggactgagcccttcccgctgagcagtttcgtccagtttttcctgtaccagcctgtcatgtttattccatgtgaatgactccagaggcaaaattcaagcttttgaatagggcacaaattaacttgagtaccctttcatttccctgtaggtgaacactcctctagccctgccttttgtcagtctggagcccttgttctaatctgtacacaccagaggactttacaaggctttccccagcctccagaattattcttctgatccaccctctactaaactcaccctttcctcagtgctaggacgttgaaaaaccgaaacaaggcaaagggccaattgtaataattcacactaaggcatgagtgactaggtttagtatattaacactacctaggatattctatttcttccaaaaggatcctgttaatccttgaaatttaacaactaatggtatagattctaagcactgtgagtacttgtcagtgggggaaagacatttttgggctgagagactttgccactgggaagagagagaggatgaggaggagaagggggatagggaggaaaaagagaaaaaagaaagaaagatgattagatgatagatggatggattgatggatggatggaaaaaaataacatgagagagtggtaaaaagcacagaatctggaaccagactgtatcttagctgggtcacttactatgtaacttagggaaagcttcctagtctctctgtgcctccctttcttcaccagtgaaatggggatcatagcagagccaacttcacagagtggttgcgaggagtggatgagctgataggtgcagagcacttagaatagggcctggtgtggagtaaatgctccacagagctagccgtgttggctgtcacccactcatgtggccagcctgttggtctacctcttagttgccatgtaacaggattctggtgcttttcctttgcccaggtcagatggaacccaggacccatccaacttggctgcttcacattttcatccccttctgcatcattgctttcattttcatagccacagtgatagccctaagaaaacaactctgtcaaaagctgtattcttcaaaaggtaagtgagttttattcatggtaacccaatgcactgggtgtctgcagcatgagccactgctttgcactgcaggcctatggcttgctgctttcatgctaaacccactcagagcttatgaaccactttgagcttgtcttgatgattatttttccccagaagaaaatggctctcatcgtcagtgagctgaacttcttacactgagttttttaaagggaatgttttgttcttatgtctgaaagagtttgtcttattctttgagccaagagctttcatcagcctcatgagagtgatgttattttggcaatgcagagagctacgtgctccgattttgctggtgggaggttgccaggatcctttctgaggattccttccattttcacccctcttttccccagtctggatatgacctgggttaaacccaccccctctcccaggaatctcaacctcacggttgggtaaggaaaggagaaaggtttgtgaggccatttggggataaggaaacagctggttggtggtgcattaacgtctttcagcagctcccttcgagtttctccttagcctgttgtattcttaccaacacactcctgttctgttgtaccagctgggacagagcatgctgaagcctttcagccctgatttcattgcttcattgttcatgtgtctgtctttggtttcctgggtggagcctgcccacaaaacccccagaatgtatgcaggcctagctggtgctttcctaaacggctcccttgtctgcactcaatgaacttctccaaagatctatacatggcctcatctatagaaagagaaatgacatgtggaaataattcagtaggagtttgcagcagcactatctgaggactaggggaattttaagtggttgttatcttacatttatactcataacttctatattttcatctgccataaaatattgtcatgttctatttgtccattgccctatgtgtgtatgtattcacttgggtgctgaccacaatatttctaactgtagaatgcaaggaattgttgccaaaagaaaaagacagagggagggaagaagatggccaggggagtgagggagaaagagaaaacaggagatggagaagaagaaagatagaaagaaaaataaatgtgggagggaagggagcttcatggtaaaggaggaggtatgtccaacagaacttcgacttttaaatagaaccacttcagagagttgtgtcaggtgcacctcagttgtcttatcttctgccattcttcttttacctctcacacccatacctcagggttcaaggcctggggcctgaggactccttaataacttcagaaatgagcagctgagtgttccgttccagctgtctttgggagaatggaatggagtcacactcaaagatagagtggaaataaatcctctcctcatccttcaccccaatcttaagagtgagtgaggatatcagtagctccgagctgggaggtaaagctcaagttctaactgtgattaggagacctttcttacaaataagaattaagtgaataaatgtgcaaacaatttcttttatatttttaatgaaccagagagaaatcatggttgcctatataacccttgtctccaactcacttgcattcagatctgctttcttacatgtgtctgccatgcacacaaacttgtgtgccatggaaaagggttgagaactgctggtgatgcagacagagctttaaaccagggtcagagggctaggctgggaccttgtgctgccatttgttggctttctgaccttgtacaaattgcctatcttctttgagatggtctttctatctgtaaaaggggaagcagcaagagaaggaacattttacagcttattggccgaacttcactgccgctagtgtggttcaacttggactacagagaaatcttcctaactggtttccctgtattcactcctgctacctccaacttggtctgttctcactttttgctataataggcttttaaaaatcataaatctaccatgtgtcctctgtccagaccttctccatggcttcttattgctcactggatgaagttccaacgagcccaggatggtttgactcatgtctccagctttaactgcatcaccatcaccttcattgtctaaagctctaaccacacaggattttctagtcctcagaggcatggcagtctttcaattccgagttttctcatacaatattgtctcttcttaaaatattttttcttgttgtccacctgagttggagtcatcttttaaatctcagctaagcttatacttcatcaagtctttcctaattctacctccacgcaccacacccattacattaaatccccttattatatgtttccatagcacctacttcttctttcagtatactcagcacacaatcacatgtctaggatctgttttaatagcttggactaccaattaaattgcatcccttttaattttccaattgattcctcaagtacccacatgcccatcttagcaagaagttcagtgtctccctcttatagcatgtacttctccacctcccacaaactgccagaaagcttacttagcccacagggccagtgctaggcagctaggttagtcctccagagggccctggttttgagcagttgctgtctactccggccatgcagaatctctggtccttccagatgtctccatccactgtgcaaaggtaaccttgctggttccgatccccacacagaccacagtgctacaagattacagttcttatggttccccaacacatgctctgtcattggtcccaaagcaggacccctatgggttgatgaggtaggaggaggtccctgccttagccacagctgcacacagccagcctcttcccttctaggccctcatgttgagcctgggacgccagtcctaacttccttctcttcagttcctcttagggccattggtatcctgaatttcttagtccattgcaaagttaagtaaagaagcagcaggcttggtccctttccttccagatggcttcttagctcctgaacagatttacccacctatacctcagtgactagctctgtgtactaaagtgtattgggagggcagccattattggtccataaaaggtcctgcttaccattttcccctaagaggaaccattcaacagtttggggctcgagggtgacctgctgggctctagagaagaagctggcaacttctgttgcaaaataatgttaaattctgcttcatctgcttgtctttacgtttcaagaatacagtaactgtgtttctctgattcaccaatatatgcccagtgtctaaaaaattacctggcatataataaatgttcaatgaaattttaaacattgaacctactatatgcaggtgagtatgctagatctgctctgtccaatataatagccatctgtggctctttttaagttaaataaaaattcatcagtcacatcttaagtattcacacactgtaagtgctcaatagccatgtacagataattgctcctgtattggacagtacagatatacaacatttccatcattgcagaaagttctactgaaaaccactgtgctagaccctttacaaacttctcatttaatttcacaaaaattgcttgtggcaaggagaagtgtctttatgctggagttaagaaagtgaggctcagaaaagttatatgacttcccaaagtcatacagctgggatttgaatacaggtctgtttgactccaaaacttgtggcctatttgttgcaaaagtgcttaatacaaattggttcagtcaatattattatctttgaacaatggaaggagaaagtaagtttcaatccaaaataattgagtgacttatacattgacttgctgagccaatggcaaagtcaagttagaatccagcagaagtcaccagctacagaatctagatctttagaacatgtcttcagatcttcagaacagtgtttcttaaactctcttgtgaaggaacagttatcatcataggctggtaacagttcacctaccagcaccagcccatgaaccagactctaagtggcacagccctagaagattgagccagaattttacagaggtttaaagaccaaatatgctggtttatggttacctgtggcccacagagaatggcagcactaacctcaggcataaatgaggtacccactgaagccaacattcaagagcaattcctatgggttaaccattgggctcctttcaaatgcaaaccctcatgaaagagactacagtgctgaatagagacctccaaattccaggccaagctcaggatagtcatgagggaattactaaaaacctggtatatagggcaaaagcagaattaggaatggactgatttcaggaacccaggcaatggcaggagttgggcattaaatcctaaaagagaatcagagtgggagggaatatgtgaaatcagaggttaagaaaaaagtgaaaacctattcatgattgcaaagatatgaaaccaacctaagatcccattgacgaataagtggataaagaaaatgtggtatatatacaccatggaatactactcagccatgaaaaagaatgagataatgtgttttgcaacaacttggatggaactggaggtcattattccaagtgaagtaactcaggaatggaaaaccaaataccatatattctcacttgtaagtgggagctaagctatggatatgcaaaggcatacagagtggtataatgggcatgggagactcagaaggagagagtagggagtggcagtgaggaataaaaaagctgcatattgagttcaatgtacactatttgggtgacgggtgcactaaaattcagacttcaccagtatacaattcatccatgtaaccaaaaaccacctgtacccctaaacctattgatataaaaaaaaattaaaagaaagatgtgaaatcaaggaaacttactggtgagcagcatcccattatgtgaacttgtgcttctgaaccagtaacttgagttactttgagccagtatcagtcacttataccttagtgcaaaattaattgatcagacattctgacctggaccagggaaggcaggcagaagtagcagtcaagactaaagcagaaaagggagagctaattctgcagccagacatttcctggattgaatacccaaattagtccctcagcctttaagtgcctgagggccaggagtagacagaggaatggaaagtgtgagacttctttgttcacactctttgcctaggggccagattttgctttatgcattaccatccgaagtcccaggccacagtgaacatttgggcttcgctatgtggatttatttagatttactttttgtcctgccatattttaatctataagccaaacagttttctcattaatcttattccatttctggaatttttccttttcagacacaacaaaaagacctgtcaccacaacaaagagggaagtgaacagtgctgtgagtaagcatgatttttacttttctttcttactttcttttctctctcagcttgaattttaaagtaaccactgttctattaattcatggaaggcaactgaatagttccagcttatagaatcttcctgtttggtagcatttcagcgaagcctcgttcttagccccagaacaatcatgccatcttttgctcggtctatattcctaagcactcctagatgatactgcactggacctctggtctcacatagttagaaacagagttaaaatcgaacagcaaagagaagatattcaactgcgatgcaattgacaatggatgtttttgcaacaaacaatgattaagaagtacattgttgtgggctctgagtcaagagtaatatgggaaaaacacaagtctcttcatgaggttgacaggtttggagctggaatctgtggaggaggaaggatatgatctaggggtcagaagaagtgggttactaaaatcattaagcctggttggatgaaaagcttagactcaggggaagcagcacatgattgtgggggctggcaagtttgaaatgtgtagggcaggccagcagtctggaaacccaggcaggatttctaccttacagtcttgaggcagaattccatcttttctgggaaacctcagttttttgctcttaaggccctcaactgattgaatgaagccaacctacatcatgggagataatcagctttacttcaagttaactgatagcaaatgataattacatctacaaaatactttcacagcaacatatagactagcatttgactaagcaactgagcaccatagccaagatgacacataaaattaatcatcacaggcaccaagagatgaggggggcagtcttggccatatatttggctgaagtaagtcaatttgtcattcctgcatgagcctttataaacagaagtaagtaaccaactactatttggtcattggagttgtccaagaggccagggttctgtctaatacctgttcatgcatgaacatgccaacctagattgcatgcagactaccagttttgggtttttgtttagttcagcaggatttttctcagctcactgcctctcaaactttcagcaacaaaaggacatctgtgatatcagaatctaccactctaagtatttggatgcaatagcaatgaatatctgagtaaatctaggtggggagtgggggcaccctgtagccaaaatgatttaacaaaatcaaaccaaaattttggaaatgatgccttggtacaatgaagagactacttgaggtaggtttgacttatctaatatcttattttctttaccaatacctaatgaggaatttaaatatttctagatagctttggaaaggtcccttaaagaggcaccagcataccactgccagatctaatccccccaaacactgttttcatcatcatcatgtcatctcttgtctctatagatcatatcaaatccttcccagagtttttcaggccttttgacaactagccacatttcactaagccaactcatctaccactcttcaacaaaacttttcctcaagttgagctgctccaccaacaccactgccatgagctcattcccacttctgtggctttgctcatgttggttatttttttggagtgtcctccctattccttcttacttgtcccaatcccaacttttggcatggtctactttaagatacagtaatgagtaactttattattataacaccaggcttctgttctaagacattagaagtgtgtttagactagctcatttaatcctcacagtagccctctgaagtacttactccctgcttcccattttataggtgaggaagaaaaacatgaagaggttaactaacttgcccaaggtatatagctaataatataagggccaataaattgattcagcaatccaggtgtccaagtccagaatccacacccatacactacactctgcttttttaaaatttaattcaatttttttttagagacagagtcttgctctatcacccaggttggagtgcagtggtatgaccgtggctcactgcagcctcaacttttggactcaagctatcttcccacctcagcctcctgagtagctgggactacaggtgcatgccaccgtacctggattttttatttttattttttgtagaactggggtctcactatgttgcccaggatggtctcaaactcctcggctcaagcaatcctcctgccttggcctcccaaagtgctgggattccaggcgtaagccactgtgcccagcctacatacacaacactctcttgcttaatctgtaagactctctcccccactcatacctttttatttttcctctgcattgtacacacaatctataccactcttaagcacatgattacagcgttattttctggctgcttctatgtgtctatattttaggtccacctggtcaatataataaagtgggatattagtgttaatgcaactatatggtatttgatatttgtctttctgtccgtttatcaatgtttcttatagtttattatataataaatttaaaaggtgtctgattttgaccaaatttgactaaatactaaaaaacaatattaaaataaattttgtttaattttagttgagtctatcaactcaaaaaagaataacctacaacaataacaagtttcagaacattttttaaattactgattttatgagtataaaaataaaaaataaaaaagtataaagaaaacaaaaataatttagaatccattgcctagaaattgccatggttaagattttaatattgctcaggcccagacagctcagggctttgacattcccacacccattctctgccatcccagttctatctcatcccaaaaccatccattatgaggagagtgtacagctctaggctgcccgggagccatcccgcactctcattttgtgactcggcatcttgggagatggagtcttgggacttagcctggacatgtcccttgcatgtacttcttacaagacttttattcagatgaatattttcccttccaacttaagaagcacagggcttgctggttttgcttcactaaccagcaactgaagcaagacctgacttgtgaaaatgcctaatagagttcagtattagcgctgtttcaccatttcctggatctcttgcctttgtgcacatgatagaattgcacttctctgtgattaatttgtagttaagtgtggtcatgtaactcgctttggtcaattaaatgtaagcataagtgatgcgtgttatttctgggtagaagatgtaagagttggcatatgctttgccatattttctttatccatctggcatggtaaccagtaacattctaggtagtaattgctccatcagtctcagtctctgagtgactaaaattgacagagtcccctgctgaccctcaatgtacatggaacatgaacaagaataagcttttgttttttatattgagattttggagttgtttgttcctacagcattacctagtttactctaatacaacatggaaaaaactggaacctataataaatagaccctacgttgccatttaaacttctagttctgaggaataataatgtggggaaatactttctatataataaaaaaatagaaaattgcaaaataaaaatatacttatgtatcattcatgtcctattaaaaatgttatttatagactcaccatattcccttcctccagaaaaatagaagtaaaaatatgaaaatgcctgtaatcatgtttttggattatggaatcaagtattgctttttacttttatgttttctgaatttttgttgtacttcactacatttttgagtgccctgatgtattactttcaaaaagaagaagaatactttctgaagccatttcaaccatccccactcacctctctagatcccagtaaccaaatacattatataggactcttcatcagtccttatcaagtttaggaagggcgatgctataccttctttaaaggacacctaccaatgtcttagttgcctttcaaagactcctagcacagctaaatgtgatggatatgctctaaggatataagagctgaagtgacttgcataaggtcatatcataacttactgttagaaatggagctagaactcagacccactgagtccttgtctgtgacacactgccctttccatttgtggaagttgttcttgtatctaactttatctgtgctactatttgggcctagccattctccctcttatgcagacaagcagataaacagtaaaactttaggagtggattatgataccatagatatatatcatctatcctttacaaaatagttattacagtcatcaagccttggttagagtttacagaccatgtatcctagctacctcatttcacagattatgacattgggggctaagagatattaagtgacttccttaagtgaaacagtagcagaccaaaagaagtcatgattcccagcatagtgctactcactcatttattcattcattcacccactcacaaacctgtattaagtttctgttatttgcaagaccctgtcagttaggccatgtgggaactagaaggatgaatttatcagtcatccaagattcttacaattaagtattaccgataaggtactcaagaaacagttctcattcacataatttgggttaaaacaaaaagaagccagctttctatatacttttggtccagtctttacgttttttgttttgttttgtttgttttcatgagtatcccgacttccttctaagaacttccacctgagaactgaccacagcgtcagcattccacatgggtgtgtttcctttcccctttcccatttcagtggtttccaatttctttttcttttggcactataaacctttcgcaaaggaaatattagacagaactcctacatgtcaagcaaattaaaatagtggtgaaattagagtggaggacataatcaccctatcatataggctatttgtccatatcatatttgtccctacaaaggcctctaaggcaggggtccccaacctctgggccgcagaccggtaccagtggcctgttaggaactgagccacacagcaggaggtgagcgggagacaagcgggcactactacctgagctctacctcctgtgagatcagcagcagcattagattctcatagaagcgtgaatcctattgtgaactgcacatatgagggatctaggttgtgtgctccttatgaaaatctaatgtctgacgatctgaggtggaacaggttcatcctgaaactatagcctacccccactcccacacccaatccatggaaaaattgtcttccctgaaaccagtccctggtgccaaaaatgttggggaccactgctctaagataccttgtgcttcttggaacatatttggaaaatcatgtagctctcaaattatccctatgtcctgaagcccaccttaccatcaatcctcagaaatacccaacccatgtcaggcaacttcacactttctttcttcaggcagcacagttgtctcagggagggaggagagtgctattagcaagaggagtcactaacagcttcactcacctgtgcccatgaatttttaatggtgtgaaaagtctgtgtattttttatggttctctatggctcatataagagggacaaacaatacatgaaagttcagagatggggacaaatatcactttaagctggggataatcagggaagaagaaagttttcatggagaaggtgacttttgaatcaggaagaaatggaaacagcaaactcttctagatagaggagacactaacaggaaaggcagagaggcaggaaggtgtgggaaagtgcacgtgaccccgttcagagagaaagccaggtgtgagataagggggaaagactgttagggcatgtattgtaaaccactaattccaggcaaaagttagattttacttactaagcaagagtgcttcagttagatcctagcaggaaatggagggtatgcttagaagaggtaactgaggcaagtttaatttataaaggtgtgtgcagcattaagggaaaccagcaagggatactgagcatgccaggatgcaagagcaggcagggaaggtgactattcctaggtctgaaggagaaaggggagggagcagttcccagaaccctagtaaaaatggcaatgagaaaggtccatctggcaggacctatggtctttaacagagggacaaagtcaacccacaacttgtctgggaggttgctgaggaatagataccccaacctctctctcaacccactgcaacactctttttcccctagactgagcccagtcaaagacagagggaggagcccagtgatgcagtctgcaatgtcatcatcctggagcatgaatagagtgcagcagggtgaataatgagtctgcaggaattaatagaaatatctgacacaatagggaactataagaggttttgaataggagaggcccctgaaatgtgctccaatattactgaactatgtgtggcccaaagaatggaagaggaacagctcttgcaataggtctgaggagagaagctgaagacttggactagggcaatggtaaaaactgtggaaagaagttttaaatgaaaagttttaaaccatgcggcttccagctagatgaacttttttaaaaaaattagttcctcactcaaattttggggaggttatatattttctaatcataaaaaatgatttttcttatttgtgggcttttctccccagatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaacgttctttatatattctacttttgggtaagaggtttgctcagggtcttgcaagtcagtaagtttaatatcctattacgccatttggctcccaaagatttgaaggcctttgaggcaaacttggatgtacttttcagcagggttgggtcctagggatgcttgatctggggctcctgctggaggaggagcacttcctaacaccacagagagcagggcaggagacaaggccttcttccctggaagaagcccacctatgctgcccctacccccacccatgccccagatatgtgattggcatgttgaatgcttggggagttttgtttaactctgttaggaacccagtggcataatggcttctgtcaaaatattcccatctttgttcctagattggggctatcttttagattaccaaatagggagagagcaatctagctgtagtatcctgaaatctgggttctgtcaggggagaaaatcataaggcaatgtgtcttagcttcagaaattttctatactacagcatgctatcttaacacctaacatttatcaagtacttgctattgcccaatattgttaagcattttacacatactattggaacaaatcatccccaaactctctgaaaaagacactattaattactccattttacagataaggaaaggcacagagaggttaagtaatttggttaaggctgcttgttcagtttgaaagggatggaattagagcaacaaacctatattttttgttacacaccataatgtgccctgatttcctaccacatggggtttaaagtggtatttttatactgtgtggtctctttgctggtcaataattaatttcagaaacaacagatgctggcgagggtgcagagaaataggaacacttttacactgttggtgggagtgtaaattagttcaacccttgtggaagacagtgtggtgatttctcaagggtctagaaccagaaataccatttgacccagcaatcacattactgagtatatacccaaaggattataaatcattctactataaagacacatgcacacgtatgtttattgcagcactattcacaatagcaaaaacttggaaccaacccaaatgcccatcaatgatagactggataaagaaaaggtggcacatatacagcatggaatactatgcagccataaaaaaagaatgagttcatgtccttttcagggacatggatgaagctggaaaccataatcctcagcaaactaacacaggaacagaaaaccaaacaccacatgttctcactcatatgtaggagttgaacaatgagaacacatggacacaaggaggggaacatcacccaccagggcctgttgagggggttgggggaaagcagagaagagcattaggacaaatacctagatgacatgttgatagattcagcaaaccaccatggcacatgtatacctatgtaacaaacctgcaggttcagcacatgtatcccagaatttaataataataattaatttcactcttttccagggaagtgctataggagtgtaggtggcgtgtgggttctggcatcagagattcaaaccccagctcaactaggtatgagttatacaactctgaatatattggttgacctctacgcatcagtttacttcaatatagtgagacctggccaggcgtggtggctcatgcctgtaatcctagaactttgggaggtcaaggtgggtgaatcacttaaagccagaagttcgagaccaccctggccaacatggtgaaatcccatctttactaaaaatacaaaaattagctggggatggtggcacgcacctgtaatcacagctactcaggagactgaggcaggagaatcgcttgaatctaggaggtggtggttgcagtgagccgagatcacaccactgcactccagcctgggcgacacagccagactttgtctcaaaaaaaaaacaaaaacaaaaacaacaacaaaaaatgcatatatatatatatatatatataaatagatatagtgatatagtgataccccatctctgcaaaaaatttaaaaaataaaaataaaaaaaatttaaaggggccgggtgcagtggctcacacctgtaatcctaacactttgggaggccaaggcgggtggatcatgaggtcaggagttcaagaccagtctggcgaagatggtgaaaccctgtctctactaaaaatacaaaaattagccaagagtggcggcgggtgcctgtaattccagctactcaggaggctgaggcaggagaatcatgtggacccgggaggcagaggttgcagttgcagtgagctgaggtcatgctactgcactctagcctgggcaacagggcaagactctgtctcaaaaaaaaaaaaaagaaaaaaaagaaaagaaaagataaagaaagcagttatctttctcagtttatcatgaggattttgagcacaggttttgtcatccccttagactcctagagagcagggaaggagtgagatttttgccatgtacctggtacgtgataggtacctcatgcatggtcacctctgagactcattatgtattgggagaatggctactattaagacttctactttttttttttttttttgagatggacttttgctcttgttgcccaggctggagtgcaatggcacaatcttggcccacagcaacctccgccccccaccaggttcaagtgattctcctgcctcagactcctgagtagctgggattacaggcatgcaccaccacgcccagctaattttgtatttttagtagaggtggggtttctccatgttggtcagggtggtctcaaactcccgacctcaggtgatccgcccgcctcagcctcccaaagtgctaggattacaggcgtgaaccaccgcacccagccaacacctttactttttatggcctggatataatgggctaaaacatatataatgacaatgcttaaaagacttagatgaattctaagtctggaaaaaaaagtactttttacaaaaggagcaaaaatagcattcaggagagtttgaggaattgagaaagaccaaacaaacaaaaatcacctatgatctcatcatccaagcacaaacactttcatgtttgctgtttgtttctgctctttgtccatttatgtatttaagtttggctatggttgcaacatgtaattttctatactttaaaaaatttggggctgggcacagtcgctcacgcctgtaatcccagcaccttgggaggccgaggcgggcggatcacctgaggtggggagttcaagaccagcttgaccaacatggagaaaccccgtctctactaaaaatacaaaattagctgggcatggtggtgcatgcctataatcccagctactcaggaggctgaagcaggataatggcttgaacccaggaggcggaggttgcagtgagccgagacagcaccattgcactccagcctgggtgacaagagcgaaactccatctcaaaaaaaaaaaaaaaaattgtcatctaccataagctcacacttatgttgctgacaagtgttcctaattatcacttttactggctgcataatattctactgagtggctgtgacaaaatttaattaactgttcccctattaatgtaagattaccgttgtttctggtttttttgccactttagttacaagcttttgtgctggatatcctccatttgaccctccagatccactctccagccttgtcctccctgctttgggtcctatgaagctgacttgtatggactgtatcaatgggctccattgctctctggcttttgattgggttcagccaatggggaccctggcaggagatcagaggatgggagaagagtattgctggggtatttattccccaggctctccgtctccagggtcactgctggctggataattctctcaactaaaggtcacagctcttgttgaatgaccctttccacatggctccatctgcctgtgggttccagtaactgctctctccagtccccttttcatgtctgggtgcctacgtgtcccctcaccccctgcaacacacacacacatgtgcaaacacacacacacacacacacacacctgttcctgctagcctttgggtactgcactattccttagagttccctacacctggcccacatctctacaaagagtctctttaattagtcctcaaattatacagttcagtgtcctaactgatatatcatgctatttcagataatgcatgtctttttacatctaatttcattaggatggatacctgaaaagggaattatggagtcaaagaatgtgaacacttcaggctcttgagtcatactgtcaatttgcttttgaaaaggatctgttggcattggtaccagtgcatccttccagcactggatattttaaaatataattttgctaagtcaataggttaaaaaatggtactttatggtaatttaagttttcatatcttggattaccctcaagtttgcttataaaacctggttattgctgtgtacgttgttattttggagtttgtttaaatgtttctcccttccccactcattctctagttgtataatctttccttaataattcaattttttaaaagatcaactttttaaagcctcaatgtcttcatctatttacagatatcctaacaataacacctctctcacagaattattgtgagaattaaatgaaaataagcatgtagcatataagaaacatccaagaaacatgaatgctttcctccttaataattatgcatggagtttaattaacaaattatgtctattttttaaaaaaattgtgtcagttttctttcaagtttatattgaaacttacttcataaaataatattatagatgagcagaacaattcagtattatccagatttgtttttatatattatgtgactttagaaaatttgtaacccttttaagccaaaatctttaaaaactatttattttattttattttattttattattttattttattttgagacagggtctcactctgtctcccaggctggagtgcagtggtacaatcatggctcactgtagccttgacctcccaggctcaagtgattctcccacctcagcttcctgagtagctgggactataggcacatatcaccatgcatgtgttacctcaggtctggtttctattatacagatcaagtaatgctttggcaggctacacatctattatctatttaattctttttttgtgtgtgtgtgtgacggagtttcactcttgttgcccaggctggagtgcaatggcacaatctcagctcactgcaacctccgcctcccgggttcaagcgattctcctgcctcagcctcctgagtagctaggattacaggcatgtgccaccatacaaaaataattttgtatttttagtagaggcggggtttctccatgttggtcaggctggtcttgaactcccaaccttgggtgatccacccacctcagcctcccaaagtgctgggatttcaagcatgagccaccacgcccggcccacatctatttaattcttagagccaaccaccaccaaagattattcctgctggtaaaaaatgctgatcgctactctgggatctcatcatctacattgagatcaggcagattttcccaccacatccttggcctatagaaagcagctgcctgaacatgttcaagggtgctggggcttctcccattaaagcatttttcaatgctttagagaagaaactattccttaggctctttcaggaccaagtgtggtgagggaagaggcacagttacatataataaatcactcctttatttctatctccttagagattctaatggcttaggccattagaatccttcctatacattattccagagaaattctggcaactcaacaccattaaatgtaacctaccagtgagtccaaatttcagccaatcaactaagcaaatagtgccattcacagctgctctagctaatacatttgtttcagctagcttttgttgtataacaaactatccaaaacttagtgacttaaaacaactgtttatgtttttatgattttataggataacaatttgggctgggctcagtggaggcaactcatttgtgctctacgtggtgtcagtgggatcattcatgcatttgcagtcagttggcagtttggctgccagatggctggtctcagatggcttcattcatatcttcctattggtgctggctgttggtaaaaccacgtatcttcagtaggttagtccaggcatcttcaacatagagtctaatccaaaaacagcaaaaaagaaagaaaaccccaatgtgcaagtgctttccaagtctctgtttgtatcacatttgctaataatgttccattatccaaagcaagcacataaccatgccaaaaatcaatgtgtaaaggaattacatgaaggcgtgataccactactgtaatcatctacaacattaagtccaaaactatctggaaagtgtagtatatcaggactaccttaatttggccccagttcaatgttatcttctgtgctcctgggtctaatacctttagaattcatccccatacatactagcctggtttcctctaatgttaagttaacaaaatcttatgattcttttgaagtataagacttttcctgctgagctagactctgctcttcccacctccgtatattccgggaactgactctaaataaaggccatgagagttgggagcactggggctgagaaagaatagggatctcccttgcaaggcaagtgcctcatatgggcttattacaggctttcaaacaaggaaaggctaatatcattagacaagaaatgagaggcttcttccactatcaagggaaactcagggatgcttgggggtttcaacattctcagtttcatccaaatccaccaaaatgtccccattcctagtctcagagtcctactcctttcaaattactgagaaaactttcacatatgagacttagccagtctgtgaatgattgatttgggttgaatttttcagtcatgtctttcatgtctagtgattcctgtaattagaaggaataagaggtactttcagggcagtcttagaagccctctggtgctctgaatatgatttgaggtgaaagccctaaacttgttagtttcttcctgtaagcaccctggtgcaatcagaagcagccatcccacattacattccttataatcatctttactaccataatggttaaatgcaacagctacttggcctccagaaacttgcctttcattggtattcaaccctagcaagaacagatgataatttaatcaaccatgatgtcaatgcatgccatagattactagtggcaaagagttcagctctcaattcaaaccaatccaacactaacaacaaatcaaatcaatcccagaatgtcagaatttgagaatctgtttcctatgaccacacctagtatcaagtgctagtatcagccagagtccagtcataaaaatagagtgtatttaatattaggaacttgtaataaagatataagaagactgaaagagcaaaaaagtggatgccaaatattagaactacagacagcagctacctttctactacctattgctacaggcatgacacattcaggaactagaaacaggaaataattccccctcccaccttccagtccccaaggccttcccatttactgaacttaacaggaagctagctggcaagggaggctggcaaatgaagtttgtcaaaattccagccctggcacatcagagcagaggagaggaggatggacttagagttgagaacaggaggtacataaccaactcactcctcaatcaaaatctatctggatgaagtggagacatatccattaagagataaaaaataaagagactataaattccaattagattgtagcacaaggaattgtcttaaactctgtggcatctgaccctgtaacaagggcccaatgtatatttgttgattggttttatgagaaaaataaaaattgggcatctgctttgaccatgagcataggacaaaataaacttatttatttatttatttatttatttatttatttatttatttatttatttttgagacggagtctcactctgtcgcccaggctggagtgcagtggcaagatctcggctcactactagctccgcctcccaggttcatgccattctcccgcctcagcctcccaagtagctaggactacaggtgtgcgccgccatgcccggctaattttttgtatttttagtagagacggggtttcaccgtgttagccaggatggtctcaatctcctgacctcgtgatctgcccacctcagcctcccaaagtgctgggattacaggcgtgagccaccgcacccgggcctttaagtacattttgtagaagttgtatcaaaattcattggctgcaaatgagagaaaacctgatgcaaactggcttaaatttttaaaagataatgtgttggcttatgtaactgagcagccaaatgtgcaactgggtatagggggtctaacaaatgtcttcaggattcaaattgtctctatcatttcttcactctgtttcctttttgttgatgccattctcagacaagatatctcctcataattacaagatggatgccaatgattattaaacctttcagattcaaatattttacaagaaaaaaaagccagagtatttttctcagcattctcagcaaaatcctgagatttacagtggaaaacttatgtgctgtgccctctccagaaccagtcactgaaagaaagagtatgtaagtgatatcttacatctggagctccacccagaccacatgaactgaaagtggagagtgaatcaaagtgacatcttttgtgctaagatgttgcaattgcccaaatgcatctgtggacttctactagaaggtatagcagaaggtgttaggtgtctattataagaaaaatatcactatcatataacacccctgggggacatatttctaaattt

SEQ ID NO: 1593 - DNA, 1223 bp, Homo sapiens
gcaaaccttaagctgaatgaacaacttttcttctcttgaatatatcttaacgccaaattttgagtgcttttttgttacccatcctcatatgtcccagctggaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatcccctcctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagca

SEQ ID NO: 1594 - DNA, 822 bp, Homo sapiens
atgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatcccctcctgcatcattgctttcattttcatagccacagtgatagccctaagaaaacaactctgtcaaaagctgtattcttcaaaagacacaacaaaaagacctgtcaccacaacaaagagggaagtgaacagtgctatctga

SEQ ID NO: 1595 - DNA, 90442 bp, Mus musculus
catctcacacagtgacttataatatgttcagattattatgggattactcgtacataaccctgccagaagttcagatgcccctgcacagggcactacactccaatgaaggaattggggctcctcagtctatcactgggggaggaaatataaaagataaaaccagagggcttgtagttaaaagaaaaatagaaatctcacgaggtgaagaattagtcaaaggagactaggaaccaactgatagaaatataaaagttaaagctggaacagttcagtaataaaatcaacagggcgctattggattaaagtgaaagcataaaacagagattccccaatccacactgatcaattagtgtgcacactgatcaactagtttgtgatgagttaggaactggagagagggagggggagggtctcacacagaacaatcccggctaactgattagttggaggactatgccccgcttgttggtgtggagtgtgcacagcgtggaggaggatggtgttaccatgaggaacctggtagatccttcccatcaggtgtctaggtctgccctaagctatattgacaagagagattcctggcacaatgtgatggaaatggaacttggtctctgcctccttccactccacagtccatgacctcgatcagatcggtgaatgtggaatattgaatttattgctgtgtagccaaggctatcctcaaatgggtgatatttctgcctaagcctcacaagtgctggggctaggaggtatctgctaccacacctggagacttacactattctcaatttatgataggacaggattaaccagtggcttctgttcattgtcatactgaataactcaaaagggctatcagaagggcttgttgttccatgacacagatataaaacaggctagattggcagctagcatagaccatattagcacactagctaaagaacctttcaaaggactggaattctgtggactatgctccctcacagcagtggaatgaaatggggaagtttatggaaaaagcacagcaagatctctaatgcttgcaaattaaccagcatattgctatatagcgcatgggttcaagaagaaaccatgccaaagacactgggaaatacttggaatgagaagatagggagaatcatgagatgtgtataagggtaaaataaaattggaaagttggagtcattagaagaacaaaccgtcagctatgaggattgtctaatattgtgagacccctgccactgacatcagccagtctgctagggcctttctgcatgccgtctagtttaatctgcaacagcttaagttaaatgaacacatccattaaaaatttaacttgccatccgggtagcggtggtgcattcctttaatcccaggacttgggaggcagaggcaggcagatttctaagtttgaggacagcctggtctacagagtgagttccaggacagccagggatacacagagaaaccctgtctcaaaaaaaagaaagaaagaaagaaagaaagaaagaaagaaagaaagaagaaaaattgacattgccacatgaaaggaagttaaagtgagacagtatggagcgatggctcagtggttaagagcactggctgcccttccagaggtcctgagttctattcccagcaaccacatggtggctcacaaccatctataataggatctaatgccctcttctggcatgtgaatgtatatgcaaaataaataaataaataaataaataaataaataaataaataaataaagtgacagtgtggtagaggtgcaaaatgcaatctgtattttaaattaaaacagtcctgcacagagatgacagggttaaccagttttatccagttggcatacattctgaagaattacagaagggctgtctgcttgtctttccatagtacatatataaaacagactagattgtttcagggtcagatagctgtgctgggaattttcagtgctaatcttgcataaatcctttcagaaaatagagaaagaggaaataactccaaagtcgttctgcaaggccagctactccttgtgacaaaatatgacatttccttatatttttataggaaaggaaaattttagacacatctgtctcataaatataaatagaaaagttgtatgtaaaatatttacaaatcaaactaaataaaaggttaacatgtgcaagtgtgtgtatgtgtgtgtgtgtttgtgtgtgtgtgtgtgtgtgtgtgtgtgagagagagagagagagagagagagagagagagcttatctgcatgtccactatgtacttgcaggtgtgtccaaggccacgagagggcatcagttacaagtgacagagctgccccatgtgtgtgctgggaacctgacccaggtccttggcaagctccactaacctctgagcatctgttcagccccatcaattttttctaaggattgttttaaacaatctttcaatgtaacttaccacattaacctatcaggggagaaaaaacaaaaacaaaaaataaaacaaaacaaaaaaacaaaatcaactcgagacacagaaacatcgtgagacaaaaattcagcagtttttcatagcatacaggaacagaaaggagcgtcccccatctagtctcaagtatctagacaaacccttagagaactttgtattttaatgttccaatagcaaatgtgctctccctcccctgtctctggagttaaggaatgcaaagctactgtcagtgtttctgttgcagcactgtgctgaggactgtagccagtgctctagagaagaaaaagcatatgatttgagagaaaagcataaacgcactatcatttcgcacatggtgaatgatgatgaatgccggaaatcctaaaggattcaacgacaaactgttagaattttaaaaaagggcaaaccttcaggtgttgttttaaaaaggtgatgatgtgttgtttaaacatggtgacttccaaatcaattgtatttctataaacaagtaaaataaattggaaggcctttcatttgcagttgaactgttaaaatcgaatgctgaatgcttacgaataagtggtatacaccctggatactatgagtaccagctgggtagcagtaaaagtaaagattacatgtgtatcaactggaggacttgatactttgtcaccaaaccaaagatctaattctacatgcacagaaattcagagaagccagactgccaagcctcaccagacagtaaccctaaatttaaagctacagtgaggaggtagctttcctgcagctttggctaggagaatggggtcttagtgttacttttgctgggataaaacatgaggaccaaaagcaacttggggaggaaggagtttatttcatcttacatgttccaggtcatcaacccagggaagtcagggcaggaacctggaggcaggaactgatacagagactgtgaaggaaccacgtgaaggaatttactaacttactctactataggtttgctccgcccatttccttttatcattcagaatcaccaggtcgggggtagcaccacccacagagagctgattcttctatatcagttatcaatcaaaaaaatgtactacaggcttgcctacaggccaatcacatagaggcatttcctcaatggaaagtccctcttcccaaataactctagcttgtgtcaggttgacataaaactagccagcacaaacagagtaagatagactccaaatagactcacacatgtagagttggttgatatgtatgtgcggggcacatatatgaagtgggctgataatctgggaggggaatggcaggcatgtgtatggaggtcagaggacaatgttcaggagttggttctccattcctaccttcttttaagatgagggtattacggcgtggccctggctgggttggacacagcgatcctctgtttggactgaaggtgtgtactaccaacacatctagcttcagccttcctcctgatgatgcaggacctctgctttctctgttgctgtgttgctgcaggctggctggcctgcgagcttctggctgactctcctgcctctgatttccctctagccataggagagctggggttacatgggctccacgaatcaataggcattttcacacgctgagctgtctcccttgattgatttttggcaaaataaaattagtgaggagaggatagcctttaaatgcatgttcccaaactcattttttatgagatccacaaataccaaatattctagaaagttgtttacaactttcaaaaatgaaattaaccgtacatccacccatcactgagtaacctgaatcctgagctacaataggagaaagctaatatacacacatccatcaaaacccatgtgcctagcgcttatggtgtctgtttaaaggagccaggagttaggtacaacccaagtgtctacaagcagtaaaaggaatcaccatgtgttcatacaatggtatgttcatacaaatattatacagcaacaagaggaacatgtctgctattctcagtatggtggctgaatcccacacatatacaatgagcagaagaagcaaacctggaagtttatggactatatgatttccctatatgaagttcaagattggctgtagcaaaggctgcctctggggtatcagctgtataaaatgcaagtcttgagcctgcaattgctttgttgcacaattcagtgttgactgcatagtgatgttcaggatttgagagtgagactttacagttgcagttattatagcccaaattcctggtaagcatgaacagaaggaggatacctgttggtttgcagtttgaggggatccagttactgtggatgggagggttggaagcagagggctcaggtcctggttgtggctgcgggaatgtgaaaccgctcattcacatctcagtagatcaggaagcgaaaggagcatcctgcctagttgccacctcccttgtcctatttttattcaatccaggatcccactgggtttgtcccggcctcattcattaatcctctctggaaacccaaaggtgtgctccctggatgaccctaagtatttcttgacctgatcaaggtcacaaagtttaccattccatcggtacaaatggtgtgctcactaagcaagttggtagcagtaacaggagtatgtgtgtgctcagactctgctgacagcattacagatcaatggaaagttctggagagaaacttaaggaaaatcttaaaaaggtggtatggtttgaatatgcttggcctaggaagtggcactatttggaggtatggccctgttggagtaggtgtgccactgtgggcatgagctttaagaccttcatcctagcttcctagaaatcagtcttccactagcatccttcagatgaagatgtagaactctcagttctgcctgcaccatgtctgcctggacactggcatgctcccaccttgatgataatggactgaacctctgaaccgataagccatccccaattaaatgttgtcctttatgagacttgccttggtcatggtgtctgttcacagcagtaaaaccctaactaagacacaaggcattgatgatttccctagtaatttcattcctagaaaattttccctcagagcaaatgaggatattaccatgccattatttataatggcagaaattggcaacacccaaacacgtcacaataggctgtgcacagtgcagccatttaaaatcatcttagagctaaaaaagtgcttgtaaaaaaaaaagagttgtaaaaagggcttgaaaaggtgttcatggtgtgttgtgagacaaaagggtgcgttgaaaatgatccatacatactatactgtttgtctgcaacctttagaatgtttttacagcaagtcccaggaggcagagggaagtgactctccaatcacggggtcggaagaggggtcagatgctgcccagttatccaacctgcttcagtagctttaccgggggcatagcgcagttcttttgagctatcaccagaccaggctgaggggcagaacgagaactgtgagcagaacaaatcctttctctattaagctgcttttgccagggtaattcagcacagcaacaggaaaagataccaggacagaaattggtcccgggaactggggccgttgctggataagcctgctcgtgcgtttcttaggccactggaactgttctgtggctgaaacttacagaagaatcggaactttggaaccttgggctagaaaagctcttgaatactggacacagagattactgggcaattctgttgggagctgagaagacaagaaatgtggagtgtggggccagctcaaggggtttctgacaagacctctgtcaggaaccggtaagaggacatttgtgtgatgttttgtccacatagtctggcttcattctgacccagccctccacctcctagaacctgaatgaagttgaatgtaaaggtaccagactaacttgtttagcagaagaacttcaagccaggagagctttcagacccgggctggggaagcggctctaactgtagcagatattcgcactattgtggagaacctcttgatcctactgggagaaggatcctgaggacaaaaccatcagaagctctcttttgtgaagatgcactgactggattcccttctggaaaaaatgtttccctgggatcagcacacaggagtctatagagctgttggcacaaggcaggcaggcaggcaggcaggcttcatctcaagggggcagcagaactcagcagcagcatccatataatgctggctttgcgagtatggaaaaatacagggctgagggaggagctcatggaatcttgctgaatattttcagagagctgctaaggccaggtaatgtgtatggggtttgagtccctgcaaggaggccaatgtgaagcagggaccacagaatactggagatgccagaaccaagggacacacactgtgagagctgtgaacatggactggagccagcccaggagaaaacctgtgtgtgtgaaggcagtatagctgaatggctgatgctatcctagtcttttggagcccagctgattttgtcacaagctccggatgccagacatggagctcaggatttgatgttttcccctgtttgattttggttttgtttttgggagaagagggtatcagatcctctggaagtagaattataggtggttacgagtcattggacagggtgctgggaaccaaggccagattctctacaaaagcagaaagtgctcataactgctcccaccctctcaccagcccatggactcccagcttttttttttttaagttctactactttaacagtcagcactttagtgttcacccttatgtactgtctgaatgtggtaacaggcacataagttaccattgtgtagagtttgtttggtgagtcctcctcctcgctacatctatttatttttttgtacaaatgtacacagataagataagaaacattccttatccccttggtccagatgtttttattgaacctcatttcaatgtgcacatctggaatccccatcctcatggcaaatttctggatttggatacccagggagcacacctcttgaagcccacatgggtgcacttgtagattttgatctttgggtcactacctcattgatggcagaatggctcttgtcttagtcaggggttctattcctgcacaaaacatcatgaccaagaagcaagttggggaggaaagggtttattcagcttatacttccacattgctgttcatcaccaaaggaagtcaggactggaactcacacaaggcaggagttgatgcagaggccatggaggggtgctgcttactggcttgcttcccctagttttctcagcttgctttcttatagaacccatgaccaccagcccagggacggcaccacccacaatgggctgggccctccttccttgatcactaattgagaaaatgccttacagctggatctcatggaggcacttcctcaagggaggctcctttctctgtgatgactccagctgtgtcaagttgacacagaaccagctggtacagcccttctttttgccaccattctttgtgggagccatcctgccaggttcaagttggaaaaaaggatgagactctagacttttaaagtgttcaaattgttaaagactatggagacttttaaaattggactggggagggggtgctagagagatggcttagtgcttaagggcactgattgctcttctggaggacctgggttcaaatcccagcacccacaccgcagctcagaactgtctacaactccaagatctgacactctcacatagacacccatgcagacataacaccaatgcccatacaataaaggtcaatagatttttttaaaagaacatttgaagttggactgggtgtattttaaagtataacaatgtcatgagactttgaggaagggtgtagaagtttatggcgtgaatccatgtttgggcatcaggttgacaagaaaaggaactaaatatgcctgtggggtattatcttgcttatatgaattgatgtaggaaacccatcttgatcactgctgaggccgttcctggactgtgtaagacagggaaagcaggctgagtactagcatgtatctatccctccccctctctggattcggtgagacccaactccttcaagctccctccgttctcccttctagccactgtggattgtggctaaaatctcaagcttcaataagccctttctccctcatgtcacttctttacagactatttcctcatggcaacagaaaagaagctatgatcccatggcagtgaggcgagctcttgccaacacaaatcagagcctttgtctctcagctctggggctcatcggctcctgctcttcacacagatctcactggggaggctgggcttggaccccactgccaccttcctcatctttgccacttcctcccatactgtgtcctccttcctgccacagtgtcttcacaggggctgtgtgccctgcagagactctgccgttcttctcttggcaagactgatgtgtgcacctagcacatcccccatgccccaaagtgtcacctcctcagagagcttgtccccggtctaaaaatagtcatcagtgcttgggccccccacccccacctcccacctgaaccctgttgcctctccttgcttgtcacacagtagaaatccattgaccatggttcctccagagggaagaggctgtcttttgcattgctcaatggaatggatccttaggggacacttggggtgttgagttggggatgtggtttgtgctcctggggacctagcaggagtcaggcgagttgcctgtcagtagcttacagaagagcaagaggacctgaccctggccctttgatcttagcctttgccggcagctgtgtgagcaatcccttggtcttaagccagtccctctttccttccaagagagagatccctcagctgttgggcaagtgggcaagagtggaaccatgcctggccaggaagatggcccatgggatccgggtcacttcagcaattcttccaaaagcagagtcattggaaagatttatgtcttgccattaacaaagggagacattttttttttttttttttttttttttttaatgaaaggcagagaagcaaggcttggccagtaggattagacatggggaaacagaaatgagaaggaaacaactgccaatgctgttgggaatgaatttggaatttggctctgagcttcctggcagcccaagtaaaaagggaagcctgatcggttacagagttcctctcattagcaaggaagacgcctgctggttcctcgggggagatgtaatttgttccagttttagattttccaggcaataaatcctgagtcaaatttctcccttgaggatgtgagagatatcatcaattgatgggataaataatatgcttgtcttatagtaagtatcaaaaagactctccagggacctgggggcacccaccatgcagctcactgggtgacagttttgtttgggtattcttatttttaaattttactagtatttatttatttatttatttatttatttatttatttatttatttataagacaaggtctctctctgtagcactggctttcctggatggatatctaactattcatggatctcacatggagttttcctcctgaagagctaagactattcataagtcacatctcgatgacttcatggggacaattttgcaaggagaggcaagagaggaacctggcttcctctcacaacacactggtaaactctgtgtgtgcagtatttgtggaagaaagcagcagaaatccatagttgctttgtgggaaagggcagctaactggaagtggcagagaagacattgtctgatggagggaggcaggctggcttgggtctccccgtgcccccaactagctgtgtgatttgtggcatgttgaacatctctgagcatgttgcctcttggtaaaaaagccatacttgctttggaagactggaagggaaacgggttagtggcaaagcatgggatgtgtgtgcgtggatgccatgcacctactgactttagctcccatcctgaggtcctcagggaattccagggagcaccctctcacccacatttctgggattccggcccaacttagtgagaggcaagcttgagacacacactgaccttgccttggccacatgtctctaggggggtcccacgagccctgccaaatggttcagaccggaggaaactagtctccaaggtctgctcatcctccgggccattggccatacccttcttttcctgtgcctctttgtggtctgtctcagtttcttcgtcccacccactctctgcagcaggcactagtcactgcaggccctgtgccaacccctgggcacttgggtcttcactgtttgccttcctggcatgtggtcctgtggattcctggcccacccctgatgttgtttcatgtatggtctcttcccctcataagggacaagtggctaattcctcagcctctcttcctgagcctgccctctcccaggtgttagttagaacttgaggtagtcctacagacttctgactgggctggagccacaatgggatacacagatccaggtcttcatccatatcccacacacgacccggtgcttcagaaagctacactgtggacacacagcaagcacctagccatttccatagcattacagctgcttctgggctctttacatacaccctcagggctcaccctagagctggcagctggacctttacagctttgcaagaagaggaaacagggtcatagctacagacactcaaggtcatactgcaagtgacagacaagggagccgaagaagcgtttatgttaccaaggtcaagagaaataagagaagttgcctcctgtcccagcccccatcaggtctcctaagcaaagcatcctcaggagtacttgaccttggaaagccctctgggatcgccctggtggaagctcctttccctgggtaatcggctcccctgaggtgacaccttcttgggactatctggaccttcctggactacctggcactgggcaggccttccaagatctcttactcaggtagaatcctttttggcaacttccagcctaaggtgaggccctccttcggccagggaacccaccctgcagcagcctccccttggggtcattacaaagaagggcttggggtagggttgttctggttccctctgaccactcacacttcctttaaacaccccagccttactacatcccttcactatctttcttgctgggtgccattttgcagatggatacaatgaggcactaggcaagttaagttaggacacagtcccgttccagctttgtattcagatttggtactgtactttgatctgaacagcaagtgacactcaccctttagtccccacgtaaatagttaatttttctcacaggccccagggcccttttcccttggtgttctatgggacgcatgttacccaacttcagttgatacttccaaacggctgagcaaccaaagggttaaaggggcccggaagaggaccctgtaagggttaaaattataaacgcatttatcgccctctgactatttattgggttgtagaccgacaacgtcgaagccgggcagagccaggaggcaccctcggatgggcttgcgcaaacgccacaactttctagcacgacccccagaaagtatcccaggcacaaagttggcgcagcccgctcctcctccgcagcgtcgccctccccgtggggcgcgcggcggggtacgcgcgagctcccgcgcggggccggctcgggggacgcggggctcagcgaggctcggctccggccccctgaattggggggtccgcgtctgccccaaacgccgctttcttccgttttccatgtcatttcctgtactaataagatggtggtcaaagcaggggaggagagcagcagcggagtcgccgccgcgctgccgctggcgctgaaagtggccaccgtggccatgaacgtgaacatggcttcggaagacgatgggcggctcgccaaccggcgcgggggccgcggcgaagagcgcgcggggacactggggagcgggggcgcaggcaggcgacggggcacggaccggagcaccggaagcggggcgggtctcaaggtggcccgggcccgcaggtcgtcgccaccgcccgacgcgggcctcgggcggcccagcctccgcctccttcctccgcgcactcgcccgccttgttccactgtagccttttcctcggctccgccgcgcgctgacggacgcggccgccggccaatgggagcggctgttcgggcccggcgttcgcaaagagagcgcgtagacagggggcagggcggggcgagggcgggatgcagccgctggcctagttgcagggacccggtcgccggtgcttcggggccgggctggggggcttagggaccgcatgcctctctgtgacctgccgcgggcctggggcggcagagggagggcgtgccttttatctattttaagtcttggttgcagcacggactcttcgggaattcgcccctgagtgtcgtctccaccccccacctcctcattcccggtccccaaggtactatgtgatgcagaaactgcagaaacttggtggccaatgaccttcctctgtcaaggccagcgtgccctaggcaagtcgctgcagggactactgagcagccttgggctaataaggcaaaaagttgctagtgtcttgagcccatctgagttggagctcagacccttagaatcagttgatgacctagagaaggaaagtctgtcttttgttttttttgaccatggcttcgtgtggaggacagccgtggtttgtgattaagagtgatcagaaagaagcacgcccagtcctttgtgcgtggggactgcgagcagtgaagggagccttcttttcatcttgagaaccctataaactttgggagttttgtctatctgaagcagaatagttttccatgaagtgtgattcccgtggcacccctgtcccccgaagaggaaggcagggactttcctaggtcttggttgatggtgtagggtgtatgggtcagaagtcccatatccccctcatccctggggagcggagtatggtctctgctgggaaccttctgggcatatggcccagaccccctggtttatttagtttcttggaaaggacatcttcaggatccttcccacggggctttggattttgcagggctgtagttgatctcttcaaggggattctccttccctgcagtgggtccagtacagcctgtgtgggagtcagctgggagagcattgagataggatcaattaagtacctggcccagggtcagactcctggtttcagaatctagagctgtgatcctgggcgatgctctgtgaaccattttgggaatcacgattgccagaccccagcctgctccacccagcccctaactgacagtgcccctaaggagcagatgctctcagggtgtggtaccttctgagtatccgtctcaaaaatgaggaacacttgtcccaggggcccttgatctgtcatcacggccatcacccccagcctggagctttctggtccaaatgtttcttaggttggttctccgaggtgtctgatgagagtccttcatctggcttactcttcacttagattcaatgtgggattatcagaaagcctgaaagaggcaaagactattggaagaggaattggggggttggagttatgctgcctttgtggtctctcacttggctttcctccataagcttcctccagggttgatctcagtgtgtccctgcctgcctcatccagtcagtccacccatctgcaagcccagggagctctctttagtgaatccaacccatcctggcttcctaatttctccccactagcacactggggaacagtacttcctgttcccaggacaactgctagggtctgagataaggcacctgctcttgccctgttccccgtagtacaattggggtcacctcagtctccctagttcctgctcccgctccccctccagtctgcctggtgcacttctgataaaggatcaaattgttgctaactgtaaagcctataacatgactctcccttatcttcagcctcatctcctgcccttctcacctctctgttgcccagcccagcccagcctgccctggccagcctctcttggatcctgacctaggatttatgaatgaatgaaagacagtgaggggcagagtggtgtggaaatgtctgctggcctttactttttgtttttgtttttagatttattatgtgagcacacaatcactcaacaccggaagagggcatgggatcccattacagatggttgtgagccaccatgtggttgctagaaattgaactcaggacctctggaagagcagtcagtactcttaacctctgagccatctctccagcccctgtatctggtggtctttattgccctcctaaaaatatttccagcagctccaggtataccacagggttgccttcagtcctcttattctaggtcaaggccatgtgactagctggtgagtctgggacatgagttgattgtggctcaaagcagttagctgtcaatgcaagactctcctaagatctccttcttggtggtgtggcatctgatagcagaattggaactgcttctgtgtcattccatgagcagtgtaccttggtgctccaccataaatgtgcagtacaactgagggatagacctttgttgtttgaaaccactgagacccaggttggcttattcttacaggatagcttatgtcacctcctccaggaagcctttctgggttaggctaaacttgggttacaggtgtttctggtctcatcctcgtctccttggattcctgttgttacttagtgatgatctttcatcgtcaccagaccatgggtcctgttttaggtaagaggcttgtgtctgagagctgctgggtgaatgccctctgtgagtacttggccctgactgaggacaggcagtgtgctccgagcctccctgagctgcagttccagcaggaaggtttcagatgcagcagtaagtcactggtcgagggcagatgcaaagctcttggtctttgcaggtgtctggacccagtggcactgagctccagagaactatgataggcaattccaggagagatagaggatgagatgggaggccccgagatctctgctgacataaggggtgattcagtgcaagggtgggaaaggaatggtggtgatatcagctagtgtccccgagggcttatacctgtcaggcactaagcagctctgtcctgtataagtcagtttctcaagactgtgtatcacctgaggccgtttactgtctgaggcaagggcattcatttagctaacagttttggaatctgaaggtccaaacagcatggccccagctccagggagatgtctttggagtgtttcattgtgctggatagcacagtggaggggcatgtgacaggggagatcacatggtaagacaacaaaagagagagagagagagagagagagagagagagagaaagagagagagagagagagagagagagagagagagagaaagagaaacccagggacctcctaataggccccatgtcttcaaatcctgcctctttaaacatgtgaaccattatcactagggtacactcaagtgctagccactccatactacatccctgttctggagatacccacaagtgttttacagatcgggaaactgaggctctgagaggtggggtgagaggtatagagcttatggcacagtcaggatcagaaagtgggatgtcacctgaaagcagccacttggagcaaaggcagaggaccctgggagctccctggatagggtccatacacacacagacacacacacacacagacacacacacacacacacacacacacacacacacacacacacacggagacaggggaggggggaggcatcaatgtggagaagggacctgtggccagccttggagaggcagtggctggtgagtgtgtgtgggtgtgagagggtggaaagggtatatcatagagcaatctctatgaaagtgtcgtgtggggtgagtgaccgttctggacacccctctaatatagacttttgagcagaggagtgcctggcccaggagtacctgggagtggggcttgagggaatgaagctggctggtaatctccacctctggctggagcctgcaagtccttggaggccccagagcctcatgttctcagagtggggccagggagggaggggcttctcggcagctggcccaggggccatggcggaaaaacaagccgtgcagaaagaaaaaaaaagccagaagaaaaaaaatgtgtgttgttatttttaaaaagcctatttcctattgcagatttgtatctgctgataccaagggggctgatgttcacacgcacagtgtacctacactagtgatatccctcagcccagcaccccaaaaaaggattgcaggaggggaagcctgggcctgggtgtcatcctgccctttgttcctacctgaagcttatatattcttgccgtgctaggcttggggccacccagcccttgtcttacacaactcataggcccgcgctcagctaggcaccaggaaaggtggtcatagggttacagttgatggggaaggggagagctgtcaatcccactcaaggagcagtctcctcagtggaggacaccttcaggatgggctttgaaggatgggctggacgcagaggaagagagagaaagaagagaggcgtctgagtgggtcagggctggcgggcagccttggaaagatggtctgtggttggtgagtgttggtgcaggagggtgggatggatatcagagcacagtgtcctggtcctgcccttgggcatgggctccctagagtactgctcccagttggctctggactggctctgtcttcagcagcagggctgccaaaactactgccttctgggacactttcctgtttagaattgcagcccgcacgattccctgtctcagcttcctgctttctctctttatgacagatcttacgccttccttacatgttttgtctttctctccctcgctgttcttagccctgtatctggcacttggtttacccctgtgaacagtgtagggttttagtgattgtggcctggaagctgtgtgaagttgtgaacgaatggggagcgttcacccttcacaacctgcgtataagggtaaaataaaattggaaagttggagtcattagaagaacaaaccgtcagctatgcggattgtctaatattgtgagacccctgccactgacatcagccagtcatactccagggctctgctagggcctttctgcatgccgtctagtttaatctgcaacagcttaagttaaatgaacacatccattgaaaatttaacttgccagccaggcagtggttgtgcattcttttaatcccagcacttgggaggcagaggcaagcagatttcgaagttcaaggccagcctggtctacagagtgagttccaggacagccagggctacacagagaaaccctgtctcaaaaaaaaaaaaaaaagaaagaaaaaaaagtgtttccccagcctagggtttgagacaccgaggctcagcaaggggaagagacttcactgttggtaaactgtgcagctgggacttgaagctgggtcacctggctcctgccttacctaacccccagttgccagctaggctggagtagctgtgctggccaagaaggagtttgtgcactggtgggctgcagggagcccctgagggattttatgagacaccgtgaccagatccttggtcaagagtgcacaggctgcatagaagtggttgcagaagtgatagagaatgaggaggaagccagcagaagagatgattacaggttggagtggacaggtaaaggctcagctcaggtgggcagagaatcctagtgttcgttgtttggttcgggaggacttggatctggggcccggcagggagtgggaagttgggaagggaccaggttggtggggttggcattgtgtcctgcagaggacctgtgccaccttcctctgtgaaccagggaagcgtgtcctgggcatggacacaatcttgtattctttaccaaggacaacatacctgaaaagagatggacagaggccacaccctcgggcactcattccacacactgaatgctgcttgaggcctgtctggctccagtgtcctctggccacagagataagggtgtcagtcccgcctcatattctgtggaaaaaaatccctttatattgttggtaccaaattgaagtcactgctccccaggaggggtcggctgctggaaggaacatgttttaagtaccatggtccttgacaacagtgcttttcacatccatttatggaacctgggctcagagaggttgattgagcagctgaagggcacacagcttagactctttccagtcaccccgtgaaagctacatcacaaaggagggctttatgtcttatctaataattcccagcaggcgactttggcgctttaaaaacgatttgataggtagggtcttggcacagatgttgtcaggacctttttccaccctgggaacctcagagtcagaacatggagtcacagttggctagacccagagtctcagatgaagtgatgatgggggaggggagcagacatgggcagctggcattctgcctcctggcatcagcttcagagtagagtagcagtggagggctgggttctatctttcaatgagacacctgaacctctggagctctctgtggcctgtggaattttccctcccctctgacacagaaggaaacccagcattctcttccaggttctgccttttctcaaaacatttatccaaagtcccaaggcaggctggctaccccacaggacaccccattgtgccattgaagaaactagtgtcttagtcaggggttctattcctgcacaaaacatcatgatcaagaagcaagttggggaggaaagggtttattcagctgacacttccacattgctgttcatcaccagaggaagccaggactggaactcaagcaggtcaggaagcaggagctgatgcagaggccgtggagggatgttacttactggcttgcttcccctggcttgctcagcttgttttcttatagaacccaagactaccagcccaggaatggcaccacccacaagggatcctcccccccttgatcactaattgagaaaatgccccacagctggatctcatggaagcatttcctcaactgaagctcctttctctgtgataactccagcctgtgtgtcaagttgacacacaaaaccacccagtacactgaggctcagagagcagaacagaccttataggaatcatttgctttcgagaggccagactccaaatccagccttcctctgtgcccaaggttctccctcctggatgtatttgtagtaaccagtgtccatactcaggaaagggttgttagtgaacacaggagagcaggctacgggtggtatatggtgtgacttaaccttgagctgagctggtgtggtcatatctgagaaggtagatgtggagacaccccccacccccaccccacatacaatcccagagctcccagtctgttatctccccctttctagaactttcctagagggaaaggatgagggctaagaaagggtcccgctgccagcttccctcggtgatggagtggctggcttggggtacaaaagaggctgagtagaccctcagttcctcagcgagggggcctgttatgagagagcttgtcatatggcagcacatgggaccgagctacagtagacccagcattgtcattgtctgcgatagggtgtgacctggagggtggggagctattgatttgacctggctcagacctcacaaccccagcagagtcagggtgactggtcttgtatgtgtccctgtatatctgtgtgcctgtaaagcccctgtgcagactagcagggttccaggaagcaagtcagagaagccagggaggttgatgtttgccaagggttcagtgtcccagccagaaggtgtgatgaagagcgagaagccccttacctcaggaaagggaagagacttgtgacttagtgcatgagagaacaggactaatccctcccaagaaatactgagccccagtaccagccatgcctgcaggaggcacatgcgtgtgcacagccctgccagcctcagctgccccactgtgcccatgttattggatctggcttgtaaaggtgaaatggaagcccaaagaagaagtgacccagagtcacacagataggaaaggctgagccgagatcacccactctgggtcactgctggtggtggctgggttgaggatctttgcacggggtgactggtggctttcccgtttcacccctgagctgcagggtagtgaagcgaaaacatagaccatgaagaaccgtagcccaggccagtctggggcatggaggactcttggcacagtgcagctgcattgtggggtggttgggcctatctacctaacactttgccatcatatagttgaccagtattcccttggggtctgggaattcaagcacactgctggatggctctccttggaaggcaagggtgacagcagactggcccatgccacgctgggaatgctgggtggacctctgccctaggtgagcagctgcgagttactgttctgctacagatccatcaagggagtgagtgtcacaggacttggagaacaaactcaagaagctcttactgcaccgtgaggtccccctgccattttcactgtagtttgcaaacgcatccaagggccactgtttggaagctgaaacaaggtggttgaggtttgttgttgttttggggttttttgtttgttgttgtttttaatcacaggtagtttgagccattctggctcccatcctgactataagtgaaggcagggagtgtgaggattggcgttggcaatggggaagagagtgcaggttcacttcccagaggtaggggagcagctgagcacccctcaggaaaagcagaagtgtgtctggagaggggagggaagggcatttgggcactgagaacaggtatgtgtaggtaagcattgggaaggccagaaagccattgaatgacaagaggtcttggcatttgagagaggggaggggatgaccctagagactggaagaacttgcgtggagctactgaggaggtcttgatcattccttagtagaggtgagatgcagcgagcttttattttaggttgagaacttctgtccctgcagcaggaggcttggaacggttagaggagggacaagaccaccctggggtgcggtccttgtttttctcttgtctgggaggctgtccttgcactcagtggagtgagttgccagggaggagctatctgcccattctatggggcagtcctggggtggtgagccagcaaggcccctagggtgaggccacagccctcctaggctgatctggtcctgagcttgtggttgctggctgtgggtgaagcttcattcccccacctctaacactagagctgcagggtctgatctggagagcagccagtggagtggccaggttctttgcggcctggtggggctcgtgcacggaggagggaagctggggcttgttgtagagactggggttaccctggtttgtggcctaccatctggagagctggggtcagaagggacagtggcctgcagttgtttcccatgttgatttcctgatggccaggtctgaggccagcatttctgccacacctggaagctaggcccagcctgtgccacttcaagggagcacagcgtaccgtgacgaggttactccttcagctttctcctaggctcttttctgagcttgagggacccaccttgcccttggtttctgggaagaacccaaggtgtgcctgggcctgcatgtggccacaagcccaaggaggggggctgcccaggagggaactgtgagagcacccctcccactagcaccagcctctcccttctccttggggccccgttaagggtgcccctggctcactctctctgttaggctcccagaccagctgggtcctgcagcagccgcaggctgggcagctgctgttcaggggagtctgcgctcctgcagaatggggtggggcagggcaggccttcttcacctgacccagcttgggcttcaggccaaccagcctggagtcactgaggtgccttggtttcgacgtggctctggtcacactggaagagtggcgctctgtgtgtgtgtgtgagggggtgaggagcagatcctaggtcggtggtctcaggtttccccctgctgcctgcccaccctgaagctggcagcttccctggttaatgtcatgcaggactgcctaagtcctgtttctcaaaggacatccaaagcctgctcggcagggtcccccaatgtaatcctcttaggttgcacccaggagtcagggctcagtcaagggcttggtttgcctcaggcaccatttagtatgccccagtagcaactccccgctcctctcttgtctttgctttgattgttttgacacagggtccaaccatgtagtcctggttgctctgaaactctctagggtggccatcagggtggtctcaagtttacaaggatctgcctacctctgcctagaaagaaaggcacatgccaccacacccagcaagtctaactgtcttggagcccagtcattgcccatttattttcttggtgccttgggtctccctagagtgtggccgtgacagcgcgtgttactggaaccactgtttttcacagaggggtgagctgatcttaacttattcatagccagcctgggagttgtgccattgacccagttggcagatggactaactgaggctcccaagagttcagtgaagatggtagggtcttgtgtgggtacttgagggcagagctgaggctcaggtctactcctcctggctcttctgtctacactggagttggcttgaagtagtgatgtcatcagtatttgactattacacggtcctgacctggggtttagctgggttcggtctgtttggggttaggattcactggacagttaggacccttgcctgggtacagtgtcaccgtcaagtacttagcctatgaacacttcagatgtttgtctgcttttgcctctctccttttggaacttcacctttgaatcattcctttcagatgcaccctctatcctggaacaccccagaagctgggcaggagctaggcagcctctggtaaggaggctgaggtcactgtggaagcggggagggggccctgggtccctgcttccctaaccggctcggcagggacacccaatccagctgtccatggggcattagacttttctctgatgctcccagccttgttgtaggtgattgtattgctgtggggtgaggtgaaccaccatttcccaaggcagatctttgtgtcttttaaaatttgtggtgctgagttttaaccctataaaggtcatacaactatatatttgctgtaaaagtggaatgttgacaaataaggcgttccttagcagacggggcattcctgactcttccacaaggctagcatcacagtagccgtggtcctgcacagttctttctggattcagtcttgtagtgtgtaggacacagacagcgagagttgcctgtagtattgactattgggtacattaactttcaacattctacctagaaaaatctggcttttctgtagggtgtgtgtgtgtgtgtgtgtgtgtgcgtgcgtgtgtgtgtgtgtgtgtgtgtgtgcttgcacttgttgggtgtgtgtatacatgtgctggtgcatttatagaccagaggtcagcactggatattttcctcggtcactttccacgttgagatgcgtggctgccagggtctctctctctctctctctctctctccatggggcattatacttttctctgatctcccagccttgttgtaggtgattgtattgctgtggggtgaggtgaaccaccatttcccaaggcagatctttgtgtcttttaaaatttgtggtgctgagttttaaccctataaaggtcatacaactatatatttgctgtaaaagtggaatgttgacaaataaggcgttccttagcagacggggcattcctgactcttccacaaggctagcatcacagtagccgtggtcctgcacagttctttctggattcagtcttgtagtgtgtaggacacagacagcgagagttgcctgtagtattgactattgggtacattaactttcaacattctacctagaaaaatctggcttttctgtagggtgtgtgtgtgtgtgtgtgtgtgcgcgcgcgcgcgtgcgtgcgtgcgtgcatgcgtgtgtgcgtgcgtgcgtgcgtgtgtgtgtgtgtgtgtgtgtgtgtgtgtgtgtgtgtgtgcttgcacttgctgggtgtgtgtatacatgtgctggtgcatttatagaccagaggtcagtactggatattttcctcggtcactttccacgttgtgatgcgtggctgccagggtctctctctctctctctctctctctctctctctctctctctctctctctctctctctctctctcctaacctggagctctctgatttggctgggctgactggccagcaagcccagggacactctctgcctccccggatttcaggaactcactggtgcacctgacttatttttacatccctggggtttgaactctggtccttatgcacagctagcactttcccaactgggccgtcttcctgttctcccccgccagcccccctctctactatgtagcccaggctggcttccagctcgttggtcttcctgcctcagtgttctgaatactgagattatgggcttgagccatcagagctagtctggctctgacttcacatggagacctaccatctttctaaagacactaatgcatagtgcttggaagtcattgttatttagccattcccctaccgatagacatggaggttagctatgattttattccagaacttccttgggcctctctggagttgctcttgctgggttatgggaacctgctgtgctttaaaaatgtattatccaatatttaaaatgtgtccgttaagagttggtgaaggaccaaacacctcccatggacgccagttatcccaggctcacttcttttgagctggatggaaaatctgcatccttgaccccagtgtctcctctccttcagtctcctctgctgtccttgttctagtgggagccgcagggaggcgcggtggtggtgggtgtccagaagatcagcagcctctggaatcggaatgcccaggctgaaatcctgacccagctcctccaagagccaccatttctagaactgtggcacctctgtggcttggctgtatccactgtgaaccagaaataacagcactcgcgtcattgagcagccttgagtgcaaagggctggccaggcaaagggtaggcagccagcagtgtccctgtagtggggtcccgcctctgccttcgttcaccatcgcctcactgggcgcagagcccacgtccctggtgagcagcctgggttggctctcgcctttgtgacgcctccattccccggtcagtgggtgtcccagaggacattgctgcctgggaatgcaacgggtgatcagatttctaccctgcttggccctgaaggttctggactggggcctgcagagagggaaagtggctgtcctggtcatttgctctgaggaggtggccaggagcatagcacctaatgtaaccccacaccgtggacacatttactggtcctcaatggggccgttgtggctgtggatttgatctctgttggcctgcatggtgggcaagagaagaaagcagcgtggggccagacttgccccctgggagctgggtgtcttagcaccatgttggcccaggcaagggtttgcctcagcctttggagtacagcattctcctggttccgtgttgagagaatggcttctgactcttccttacagccctggcaagcagcagagtctgccctgcctgaccagcttgccttgtgaaacaggtgccccggttgtggccgttgcccaggaggagagaaaccaaggttacagattcctaaatgacagtctcaaagccacccacatggttgaccactggcagggctgggagtggtagccaggccatctggctgtctattcactcctttcttacaaggccacccaatgtgatcattttggcagagggtggccagccgggcggcctgcttagccttgcctctccgggcagtggcgtgtggtcagcgagtgcagacagctgggattacattttaaaagcagaggagtgtgtggctggccccagcccagccctccccagcaccaagctatacaccctcctggtggttgaaatggccagctgaagagtcgctgctccaaggtcctctgccctgttagagggaggacactggggactcccagggaagcacagaaaagccatcactgggccagttttcaacggggaaaagtaagtctccgaaagactagtgggctagagggtgctggtgggtagtagggcatctgcctgccccctctgtccagctgctggctcgtgctggtctgctgtcacctcattctgaaggtactgacctggccctgctcagagtgaaggttgtaagcatagtgtcagagggatttgtacacgggtttcacacatcgcttgtgtactgagcgcttacctatggctagatgatgttcagtgccttgtgatgagccaactactcctcagaataacccatgatggccgctgttgttagttcccatgtgtagctgggaaagcctcaccacgtagcccagactggccgcagattcacagggcttctcttgcctccgcctcccaagtcctggagttacaggtgaacttggctagccccatcccagtcttctagcacaggctgtatgagcaagggagccatcagactgtggaataagggcttttctgggaggcagtggtgactgggggggtcttgcgggagttacgtggactctttgcacgccagttttgatgggaagaggcccagcagtgcagtttgaaagctctgtacccagggccccggccacagcagctgtgctcactctgggagacctgcagcagagctgattggagctacatcctagcggggaggtgctgcttctcccagctggccatacacacgctcagctgccagcccctggagtggaagtacattctctctgcaagggcggctgtgggtgttactggtgctctgggaccagagggacagagggcagatagtgtgcccaccttcatacaggacacttgtgttgccattgaactctttcagcctacagtgctcgctcccccccccaccccccgcaatcccctccccgccccaagcctccactgagcctatctctaacacagctcaggaaggtctggtaacttacctgactcactcgccttcagatgaacccctccttcagtggctcctgtgttcctcatgggtcccacaaatagaaacagctgcctagatgagagctatacccagggtctctactgggtctggttagttctatgagtgacacagccacataggcccctgtatgcagggaatccttcattccctcagccacgtttactctgcacaaatagcccaatagcaggatctctacaatggtattcacacttgctctgtggccttttgtaagccccactccctgggtcagtaagggatctccccccaccttgccagtggatagaacatggagggcttgctgttgggtctgagactggaaaacacatagtaggtatgagggctgccagtgtccccttgtcacactcacctgagggctggagatcaaggggtctgggttcagatcctgcttcgtcgcatccctgtagttgcccaagtatcctctcggagctgactctccctcacctgtgaactcggagggcagcagaatgggcagctcactggaacccaggcatgtctgcttgctggaggtctgctgccagggagggaacaaggagggacttaggaaagctctagagcccgtgccaacagcccaggaagcagaggccagaaatagaagagcccggagacaggggctccagatggccaggctgccctctgccaaccccagaggccaacccaagcccatgtacagtcctctctccaggggctggtcacagcataaattactccttggcagggcagactaattttaccttcgtggttttcatgattcatttcccattcggggacctgtgagagaaatggaaaggactctgctagttgggtgctagcatgctgtgtccgtgtggggttcccctgggctgtcatgatttggtataaatggtgcagtggatcccagggctggaatccatcagggttttgtttgtttgtttgtttgtttgtttgtttaccatagcttatgttggcttctgtggtagagtaaggaggttgatgggaaggtgtttgtcacttgctggtccagtgctgtgagtttttggatgccgccccccccaccccatcccacccctacattgtagtcacagaaagccagagcaagcaggtaatgaaggaaatgaagcccagtcgcctcattgttcagacagggagagtggggctcagcgcctaagtggaagaggtcccaggctcacagcagcacagcccgacttgtctcattttataaagggacaatgggaggcttctctagttctgatcacagcagggcgtgtccctctgccacttgccttccccgattctacttgagctgctccttgcagggacctggctgcctgtgctctcatttccggcctcctgtacctctgggagcacaagatgtcatccacttgagctccgagtctgcggggctcagggtagggagcagtccagaggaagtcgagctggcagctggatgcatcccaggtcctcagtctgccatacaggtcaccagctcggaggccaccacaggaaactcagaggctggctgcctggctgcctgccttcagagctggggaggctggctcatctgagcagggctcccacttgcgtccagcacaccgccactgtgtggagccacctgcgcaatgtgaccagcctgtctgactgtagagagcagacaccccaggctttcctgagggttcttctgtttctttaaaaccggcagaaagaaaagttgagatagcaacagctgccagtgtgccacctacatatacttccttccttcctgttgcctcagggtggagcaggttcgacagtgattttcttgtgggatcctctcaggaagacctgtcctggacagaatcccttcctctcttagttgcagttcatcacctgtcctacaggggtgccacctgagaatagtagcaggagggtaggctttgtgctggtaagattgcatatggctgctgtgcagctttggtcaagccacttaacctctctgaacttccatctgaaaagcgaaggaaaactgtttgcaaggtcgtggactttatggaatcaccacctgccagaaactcagccgtcacgcaaaaatggaatgcatgtggctgagctcgaggtccaagaggatcctgagagcttcaggcagcattggctccaggggctcgtacagtgtcttcaggacaccgtccagccttctctgctttcttctgtactggctctcctcacaggcagccactggggtggggttgtgggtgggggtgaggcacaagcctggcagcaggcacagctgttctgcatccttttctcttcgcagtggtctcctgggacactccaccccttcatccattggctgggtctcctacctgtccaccctgaggcaataggaaggaaggtgcactaatcactgaggactgctgatccaggctctgactggttggtcttcacaatcacacacctaagtgtccccaagacaccagacagtcggtgccagaaaaaataagggtcagtaaggcattcccataggcatagctgctgacccatgaggacaggaaccctgttctctggattcccagcaggtaggacagtgctggcatgcagaactgcaggaggacaggccacaagggagggaatgggtgccctccactgggtttagaagacaccccactctgccagggcattgtcacattagagcgtcccccctcccacctccttcctggaggcccgtgaggaaggtcaccttcctggcagtgtcactgctctgcagagcctcttccttctgagcttgtcagctccaccagtgcagtcccacaaccgcagtctgtcccacaggtgtgacaagcagacattacgagtggtagtgcccgtgtcaccatacatacgcaggtttattagccgacatcatccccccttggtctccttcatctgtaagcttcagtagctccccacgctgcttgtccttttgaagcagagctcctgccctgtcacccataggaagggaacagtgaggagtgagatcatgtgtagagtaggtgcttgcgaaagggcagggccaagccaggatctctgccaactcatggatctgtacgtgagcccttccaccttcgtggaaaaactgcttactctggtgtttatacatgactaccacacacacacacacacacacacacacacacacacaagagtcatagaagaatcccaggaccatagtgtctgtactagagtacaaaggatcagaacaactttattgccagcagctccgcgcacagtaggctccccctgcatggcagataactgcattggcaggacaggtagatcaccctgccctcaaatcacagggaagaatgtgatgagcatacagtgggtcgctgcgtaggggaagagcccagggttgagggctcagcaccttccagggcaaacagagaagccaatgtctgtcttctggaagccatcaggtacatgctcaaagtccccttgacctactttattactatgtgacccgcggcagaaatggtttgggggccagagaacaggaagcccttacagccagagatgctctgtggagatgttgcaaggatgcccagaactcaggcgggcagccctaccccatcttgagcatgcacttggacagtcccctaaaccaggcatgttagacagactgtgggtcaggaagtcgggggtggagcctagggttctgtttaaccagcgagttcacctctcacctcacttcaccagctgtccagagccgctcggtacatgcgagtacatctgagtatcagagccattctatatgtgctgccaatggcatcaagtatttgaaaatggatttctttgtctatgtgtgtgtacgtgtgtgtgtgtgtgtgtgtgtgggtgcacacgtgccatggtgtatgtgtggaggtcagaagataacttgagtcagtccactccttccactatgttatgcctggggattgagctcaagtcatcaggcttggcaagaaggacctgaagggcttttaactcattgagctctgagtacatttcacacagcaaccttaccaagtagatgctgcccatgtccacaggcccagagagattcaggcgcctccccagtcgcactacaataacttgaagcatcatggaatgctcttctcatcagccattctgtttcaggtcttgctgtcaccatggaggaggccgtgcatcccagagcctgttgagtgtccactttgcaccaagccctgttctggctgcaggggacacagcaagggacagaatagataagcatcttcacttcctggagtctacattctagttggagagagaccgggccgatcttataaataaataccatgcacattggttggataacggtgtggtcggcagaaagtacagcaggcaggagagaaagagcaaggggtactagttaatgtagaatgcccagagatttgacatcagtcgaagcctggagggaggggcaagccatgcgcatcctctggaaagagcactccttacagaggaaatagccaccacaaagtcatgtgggagggagggcaggctcctggggctatgctaggggtagtgggagaaagaaccatgagtgacgaggtcgcaggaaatgggtatggtgtcctgtataatctgctctgcatgagatggtcactgtgcagggtttgaagcaaggggccccatggtgatagattcgccttgactgtgggtgcccagtagggcgccactctggggaggctgctatgtgtgagtagctgagttcaggaagagtcactgggaaggagtagcttccttctttagtaaagctgcctgatgtgttgatgtgacggagctcccaaaccctagggaagctcggagaaaaggagagaaatggtggcatggaagcccacgtgtaacttttacctggtttcgtggtgtgagatcagatcacactatgtagcaggggctgcccttgagttccagatctggggtgaaggtgtgaggtatcacatccaggttctgtgcatcctgaagaggcccccgtaccaggtccctctccgtagagtgcccagtgcaaactcccaacccagagagcatgcatctgagttggtttccaaggcccagacggcgagctgaagccaccaggaacaagcctagtcagaaggggccccgtacctgcagtggggcagggcaaagcaagggtgggtgacagctgatcagagcggtgaccctgtcttcagaggcttcagagagagagagagagagagagagagagagagagaagcttccaggcagtgaagaggtgggctggctttcccatctgctgaccggcactccagctttgcccatcgaattccccccttccagtgtgtccagtaccaaacagttctcagatcctccagcctcacctgtccacactggctttccaggctcagcacagactccagaggactggggctcagtctcacgggacgtccacttcagactatttttttcagatcctaagtgtctatgcttcagaccactgtagatcaaggctccgagccttcctcagtctctctccatcatcccctgggttgatttacagaatgaaggaaatggtgtttctcaccattcctggcttatagaaaaggcccaagccagacactgccagatagaagagctgcatagggaatggtgtgtgcatgcatgtgcgtgcgtgcgtgtgtgtgtgtgtgtctgtgtgcgtgtgtgtgatacgtagcacatacatctgtgctctgggatgcacatgtgaagactgggggttgacgtccacccccatttctgtccaccttccttttgagacagggtttcttgttgaacctgcagctcactgtttcagcagactggatagcctgcaagtccctaagctctgtctgtcccctcccccacaggaccccatactcggattgggtgtgggtgctgggaactgaactcagtctctgtgctagcccagcgctttactcactgagcacttccccaagcccatattttaaaaaattgtttagtttagttttctggctctggtcattggatccagtgccctgtgcataccaggcaagcactctgcctcagaatcataccccagccatgtgaagtagggcttaatctccagcccctgttccccagtttcagagctcagtgggtgaggctgaaagctctagcactggccccaccctgaagctctctggagtccacagaagtaaactcaggtgctggccaaagggcttctgaggaataacaagagatattccctttagagagtgtgccagaaaccaaggacaaggtcaaatatgtttcttattgtacccatgtccttccgctctgttggctggcttcatggatgtgccctgcaaagccttctgcagagcttggctgccttggctgccttggctgcgggctttctcactgaagtcacaaaataaacacctttcactcactttgactaccccaaagtgggtcagctgtcagctgcagaggagagaaatcgtgtgtaatgatattccttaaacaccaggttcttgctggtagggatggcgcacgccttaaatcccagcactttggaagcagaggctgccagatctctgtgagttcgaggccagcctggtgtacagaatgagttttaggacagccaggactacacagaaaaactctttcttgaaaactaaagccaaaccagagagctggctggagagatggctcagggattaagagcactggccgctcttccagaggacccaggtccaattcccagcacccacatgacagctcacaactccagctccaggggacccagtaccttcactcacgaatgcaggcaaaacaccaattcacataaaataaaaagtaaaaccaatcataaaaaagaaaagaaaagaaagaaaaaaaggccaggcttcatgtccagtcgccggtaagaccatggaggtgtaccattgattgacacggtggctcctgcttctggggctgagagtggcccagctggtgcttgaagggagctgtgacacctgagtctgtcaaacacagtgggatgcaagcccacaaaaatagtgccactctgaaacagcttcttcagggcttgttctgacctctgcctttctgagtcctaccaacagaagagaacatgtggtacatttcagaagtcctcccagagggagcaccttaggaggagcacagttcgacaggcccaaacagttgggttccacagcaggaagccctgagctgactagagctcagttccacagttgcctatggtgtttcctgcctttgggtcccctgccttaggtcttgcctttgcatgctagttcatacaagtacacacacacacacacacacacacaccttacagaagcatgacaagagatacttccacaaatatacccatggaaccagcacccaggctgagaaatcaaacctgattttagcaccctaggactcttgttttctacctattccagttggctccaagaataactctgaacttgacccctactttacttcctctcgtagatgtgactacatacctgatagaaacaatttgagggaggaaggctgtattttggctcatggtccgggggatatagaccattgtggtgagaaggggtggtgtctggaactctacctgtgatagatggggtgaggcttattcacctctcagtgacaggccatgctgcagagagaccttagtgggaaccggtaagccccgactttgggttctcctctacctgctggaacctagtgcaaaaggttcccacaccttccccaaacagtgtcagcagcggggactaacttctcaaaccctgagcctgggagggaactgggctaggaaacagtttcacactacagctgtcctgggtttgttccctttctttatataaatcaaatcccacaggggttacggttgagccatagtgttcatatagttgtgattagaatactccccttcccgcattgcattctatccattgattggttttattttaaaacatgaagctgaatacattggtatatgcttgtcatctcagctcaggaggctgaggcaggaggatcaagaattcaaagctagactcggctttagcagactgtctccaaaacaacaaaacaatcaaaaccaggaagtttgctgagccatgcatgcttcaggaggaggcagggcagagtgagtgtgcatggtcctttagggcctttgcttaggatgctgaccgctcgccagcctgttgatctgattggcacatagcctgagtgtggtgtgaagggagggaatgcatgcagcgggcaggcaaatctttcagagcaggaccataagacaagcccagggatgcttcatggtgaacataccaggctgccttgctccattggtgggcccctcacccatcacgtatgtgcccagtgccccctttgtactcagtttctaacctggatccctccctttgccaccccggggttcaatctaagagtctgttgacagatgggaagaattcctttaaagcagcggttctcaatctgtggctgtggattgcaatcccttcgtggatcaaaggaccctttcacaggggttgcttaagatcatcctacatgtcagacatttatgttaggactgcagttatgaagcaacagtggaaacagttttatggttgggggtcaccacaacgtgagtaactgtattaaagtgtgcagtgttagaaaggctgagaagcactgctttaagtgcttaattctctgagcccctccctcttttcctccctttccccctcctcccctccccatcttcccctccctcctctcccctctcatgctgaggtcaaacctcatgtggtttacccagatcctccaatgggattactttgtgtctctttgtgccactcctgggctcactccacactgtatagcagttttagactcaccgcaaaacagttccatgtccctgctcctcgctcacccaccacaagagcatgtgtgttatttcacttggtgaccttacagcgagaacattgtcaaagtccactggcatgggagtccctcttggtattggcgttctctgattccaaacaaatgggtgactgggtgctgatatgtgtctgctatcagagtgtctgtcacttcctgagcagtctagtcctctgctgcttccccccccccattactgtccccacaggtgtcctttctcagaatgtcacacagtggtagccgtgcaatacacaaatttcctcagtgaccgtctccactctcctttcatgtgtggagcacgtgttgtgtgttgagagtcgcccagcagattgtgaactgccatccagccttctagcccgtgctctgtgccaggttctctctggtttggaagtttaaagcacttctgtgtcttggtgagcataaatcccaatgtaggggacagctctgcaaatccgggtttgcttgagccatcgcctgtacgattgcttcctattgcttccttacagcggattcctagggggagatctctcatgcagagagagctggcccttggattgaggactcaccctgtagaaacactctcccacgaatgtcacactccagcccctaacatttgagtaaaaacttctcgctctgggcagtcttcaaaggcttgaggagtttaaggttttgtgtgtttactaatggagatgtacaatggaaagggctgcctaggactaagaaagatcccgatccgaggtcgagttcaagccgcgaaaggatgagaactctgatgatgagtgatgtctgccatgcgtgtcacattggagactataggagactataggtgctcatcatctctgacacccagagcccaagtgttaataagattttacacttttccactgagcattttagtgtttatcacttcttttataaaatgttcaaaatttttctattgagttgagcatcgtgatagctggaggagaagtatttttctattgagtgtagtaactgctgtgaagctcttcatccaagtgctaaaggtacgatttagggcttcacacatgattggcaaaaggcctacttctgacctgtattctcaggccaactccaaccccccctttttgttttgttttgttttgttttgttttgttttgttttgtttttttcgagacagggtttctctgtatagccctgactgtcctggaactcactctgtagaccaggctggccttgaactcagaaatttgcctgcctctgcctctgcctcccaagtgctgggattaagggcgtgcgccaccactgcctggctccctttaatgcgtatacttttctttctttctttctttcttttggagacatgatcttactaagtttccatggctggccttgcacttgcgactctcctgtcaacctcccaagcagctgggcttggtttatgatacttttaaatgacactaacatttaactaacattagaactactgttaataaagaaaccctgtctcaaaaaaatgtaagaactactgttaataaagtatttactagggactaaacattgtgtgcgcaaacctgacctgcgaagcagaaatgtgcagatactcagtccctctaaacaaatgggaagccaagatgacaagtggtcatttgtcaaagcctgggtgtgaccatgctggtattggtgacagaatgtatgctggtgtaaaactcccataaaattaactggtttgtagtggctcacacctttaatcccagtacttgggaggcagaggcagatgtgagttcaaggccagcctgatttacatagtgaatttcaggacagtcaggactatgtagaaggatcttgtctctaaaagcagggtggagtcccatgaattctgtaacatgttttaatagatttatctcacgatgatgcactctagtaatcctggcttgtgaggaagacaggaggattatgaattagccagactcttatcttagtgagtcttggaactcactatgtagactaggctggtctagaactcagagagttctacttctgcctccccagtgcttggattaaaggtgggctccactgcacctggctcagactcttaaaaaagtaggtaataggtttttttttttttttttaatgccttttgcatgccctaggagcagctacctgcatttgcaggcgtatcttacaggtaaattcaaggaatattgatcattctccccatagatagtgcttgctgggcacataagctcaaccattcaggagctggagagatggctcaggggttaagagcatttgctactcttacagagtatccaagtgtggttcttaggacccacactgggtgacccacagctgcctgtaactccagttccaggggatttgatgctctcttctggcctccatgaacacacacatttacacataccttggtatatgtgtgtacacatctatacatacatgtgcacacatatacaaataaaatataattttaaattcagctattccttctaatacttcccaaatgtccccgctcccgctcccgtggtctattgattaacaccattaattgatggggtacagattaggaggttgaatcgggaggattgccacaagtttgagactacatagtgaaaccctgtcttaaaagaaaatgacttttcaagaaggggaaactgaggcttagaacataggtagaaaatgtctcaatttatggcacaaacaagaccaagcgcccaggtatacatctgaccttgagtcctttagatattcaaggggacaggcagggtggataccaaacagcactgcaaactctccgggggccagacttaaggaagccaagtgggcacagcctcctgatgccccagtctcctggctgccaggcaatctggggtcctggctctctgccaagggtgaaaatgagctgcaggcctctggccactctctgcccctcctcttgggtttgcatctcattgctggaggttccaccaggcttaatctctgcgagtgcagactcggaggagccagactggagggatcagtgccagcagcttggagagcttcatgaggctgccctctgcttgggcaaggagaacagaagaagtggcttttagagcctcacctggcctgtgccttcccctgatatggagtccggtgagggtcaccagccccaagcggtagttcacttagtcacatcatattctgacgcatgttcctgtaagccttccattgagatagggtctatttcagagtaaaggttcctgtgacccacttcaggcttcaaacgcacagcactcagacaagtgaggcttggccatggcctccaggcagctgggcttttctgagaatggagaggcctgagtagatgtcagggacagtgagagcaggggcaccctttttgttttgttttccgggaagctgtcccatcactaaccatctaacaacaggttattataattcattgggtgccacatggaagagcatagaagacagggcaggctcgtcatatctgacactctgtttcctaagcatcctactttgtacaagttgattaactattccttgtctgaaaacccaaatccaatgtatgtcaaaatctgacatgttcaacagataatcaagttttggagctttgggatttggtaaagagtatgccagcatcctagtgccaggacactgccaggtctgaaacacttttggtggaacatctcagataaaagtcatgttacctgagtgtgattctgtaagaaaaacgtgaagaaccacatgcaaaatgcacatgtgaaagccacaggcctctctactcggaggtggaggtgctgtctggtggctgtttgttttggattgtctatgtgtctcttctagttcctagccatgtgtctctttccctcccattgggtgcccttgtctctgggcagccaatgaaatacagcccttgtaaagccctggtactcagctctccaagtcctcccctcagtctgtatcccaattctcccataagatgctctggcagctatgatcatttttgacttacccatgaagactccttaaggcttagcacacggccttctgatgtggctgctgatgctgtcatctacaatgttcataccccagaccttgaacaaagcagagtctggagagatggcacagaggctcacgctgccctgtcatgggactcgcattcactccccaccatccacaccaggtgactcacaaacacctacaattccagctgcaagggatctcacaacctctctgatctccatgggcgcctccactgacatgtacagacagacagacctaaatcaataaaaagctttaaacactattgtaagtttatttattcttatctgatgtgtatgagtgttttgcatgcatgtatgtctgcacaccacatgcatgcctggtgcccacagaggccagaagagggtgttggattctctggaactggagttacagatggttgtgagctgcctgccaagtgccagggatcaaaactgggttgtttggaagagcaacaaaactgctcagctatctcttcagcccctattaaaaaacatgtaaaaagaaaagaaaatctcatgatgtcttaagtaaggttacggttttgtgttagccatccttgcctgcacgtgagcgtgtgaaccaaggacgtactgtaagaattgggctcccagctctataatctgagtcagctgtgcctgtcactgcgctagcctctcaatgtcagccttgtcatctttcttgacacgcaccttgccctgccatatggggaaggagagtcaaacatagcccacaaggcttctccttctgaagtctcttgtacagctgagtgtctgtggagccggtgggacacaggcgacacagtgcattttgacctgggccatttgatcatcagttcattgggcagatgcaagttctgccggggtgggatgggcccgaggccggggtgggatgggcccgagaccagggtgagacacagcagatgctcagagtgcagaactgaaggatgtccactcctatgcctcacagactccctgggaatggaggaggtcccttccatttcatgctccagtccttgtgtgctttcccagcctccaagcatttcctggcgcccgttacaggtgctgggacaccagtggtaagcctgagagcctgggaaagccatttgtcccgccttctgggagcttacagttgcaagctagctaaaggccgttttatatatatatatatgtatatatagtgtgggggggggggtcccaggcattgtggctggtggagtagacagggtccagagaaggggaacactacaaaatgcccccaagctgtgtggtcccagaaagccagcgtttgtcagtgattgactaaaaaagagaaactcaacaacctagtggagagcattctaagctgcacttgttggtgctgcctggctgtgtttctgattagctgtcttttttcttcgtttcttatttttattcattttaccttatctatctatctatgtatttttgagtcagggtctcactatgtaattctggctgtcctggaacttgccatgtagaccaggctggcttcaaactcacagagatctgtctgcctctgcctcctgaactctggggttaaaggtgtgcaccactataagtggctcctgatcagctttctatcctggggctgtagcctcttccacatttatctctgtccctgccacccaccacatctgatggaatctgtcattggacacatttcattggaaggagagtggactcctacaaactgtgctctgacctccacacattcatgacccccccccccccatacacacacacattagatagacttactgagagaaatgaaaaggtagggaagtcagacaacctttgtaagactctggggagccttagcttaccagggaccccctgagtgaaactcgtggagtcgggatcgatgcaaaaaccaagagaaatttattgttccagtgcactggggtcatcccagacccaaaggaggggcggcgactcccagcaccagttctgctgcgttttatatggtttccaggggcagaatagagcatcagcaactaggcacaatatgattggtggaacagtgcatcctttaaactgattggtttttagggaataggtgacaaggacttcccttgtctgaaggtgagcaatggtcagtcctgccgaatgtgtcccccacccgcagttcctgccctgtgtgtggtctgagaaatgctactagtagtagcctctaccttctggaagggcggagtgtttccccgaccttcccaaaattcctgagttgaccttttcaccttcattatcaagcttgccaaccatggccaagtaccacagactggccacatggctttacttcccaagttctgaaggttaagaggtcaaaggccaaggtgcactcagccagatgagggctgtctacattgcagatgggacttttctactgtatcctcacaggcagagagccctgtgtcacctttctttatgaggttacctgaccctgaacacctatccagtctttgcctcctctccaaatagtgtcattaggatttaggacttgaatgtaggggagcgacaaagggttcgggctcctaacacctgctccatgcctgcgcagcgtcattgagacttgaactctcagagtgaaggctgttcctagacgcagttgtgggactcctgcccttgcaactgcatcccagtcagcttgcgtgaccttgggccagtcccttctcagccttcagcccttcgcaccccctttctccgcgggtggcaagggagccatcgccaaggccgggaggtggagcaaaacgcggcgctcgcacccggggcggtgcaggtggtgcagggcgcgggctgcggtggccgaggtgggtgtcggcggcggcgctgcggaggcggctgcgggccgcgcgcgaccatccgcgcgtgaacccggaagaagagtgtcccggggtctggcatgaggaccgtggggaggggctgcagccaggttctgtggtcagggcggtaagcatgctctggggacactcccccctggagagagaggtgggcttggagtcagggcagggctagccctggctggcacacaaccagctccccagccccgcctgtacctgctgtgagctgcccaaggggcccggcttcttcctcctggcagcccctcgcttggggcctcacagccagccatgcagagctcatttcagctttccactccctcgggcccagttggatttgtggagtccccttcctgcccactttggcagtttgtcaggttcttgggggttccttgtgtcctttggacgtagtgtccgggctgtgcttctcaggcctgcctcctggcctgagctgcccctgggccttgaccccatgaggctggtggctccagtcgtccccaggaccagcccgggatagaaatggcatttcctcttggccaggctacagctgtttttgttgtctgagttctcaaggcttcctcttgggatggcagggagggtaaccagactcctagggacccctgctctctctcccagccactcacccctcttcccctgtctctttcatcttcttcctgtgctggtcccgcctcccttgcctgtccccaggacagaatgactgagaacatgaaggagtgcttggcccacaccaaggcggctgtaggggacatggtgacagtagtgaagacagaggtctgctcaccactccgggaccaggagtatggccagccctggtgaggcccctgggtggtgacttgaggaggggaggtgggtggccatgctgggctggttggggacccaggggatgttcttactggatgccagccttccttgttggacagttctggggtcagaggtgagcaggcactagacggatgggggcagagtttcccagagcccaactctcaggaattcccgcgctccactgctcctacagtgaacagccagcctgttggagtttttttgcccatctgcaactctctgcctcctggacaggtgtccagtctgtcttccccttgggttgtttctgatggcttcattgctttcctttttttttttttgtgggcccttgcccggagcagctctcggagactggagccatcttccatggaagttgaacccaagaaactgaagggaaagcgtgacctcattgtgaccaaaagcttccaacaagtggacttctggtgtaagtagagctgaggctctctgggtggctcctcccttcaccccatatcccatctgcccctgggtcattgtgccagagtcgcagtgagaggcatccacctggggcacaccagggctcagcagcctgtcttgcgtcttagagtccacagatgaccccaaacccaatttttttcaaatttgagacagaagccttgacattatagcatgtccttcagtcctccagggagtaagtatcatggtttattgcttctgatggacctgggactgcagctagctgggcagatctagggttggtaggcttgagctacatgcacagtattttctactgatcctcagtggcccccagttgtttccccagccagtaaggcggcggttcttatatcccacctctactgaactttccctcttcttcacattcctccagtctgtgagtcctgccaagagtacttcgtggatgaatgcccgaaccacggtccccccgtgtttgtgtctgacacgccagtgcctgtgggcatcccagatcgggcagccctcaccattcctcagggcatggaggtggtaaaggatgctggcggggagagcgacgtgcggtgtataaacgaggtcatccccaagggccacatctttggcccctatgaggggcagatctctacccaagacaagtcagctggcttcttctcatggctggtgagtgtcccctgtaccattcattccctgggagaggtcgacaagggactcggagggaaacagtcaggtgataatttatgcgtgcacaagtgcttttctgtgcacatgtggatgacgggtcttgctaccgtcttgtccagccatgtggcttttgtcctttggtgtccaaaggccatgctgaagggaccccacctcagcagcaagcaggtgagtcatcaccaggtaataggtaaggctgattttcccaagtgtcctcctgtgtgggtgtgtatgcatgtggctgtccattcagtggtatttacaaagacctcagccaacccgtcttctaaaatggaagacctatagctcggggctgcaaggtcatagaacatgacgttctgctcagaaaatgggcaggcaagggactggacggaaggccttccaagacaggcacggttcccattgttgagagtgagcagcgaacaagcatgtagatgtgattgttgccaccagagggggagcacagcatactttgggacattatgtttgtggtacctggagcctgcattgggaatgtcagccagctttactgtctacagtctaatggccttgagtgtatcacttttttctctgggcctgttttgcgacacaggctaataagagctgcggtgaagataactccaggtggcctggcaccgttcttgggaatgtgatttctcagtcactaaagcatttatcattgcttgatgttactgctgttggcctggttgaaggctgagttccttcagaataagaattggagaatgaggtgcagctggtcttgggaggggatagaccctcattccatgtagacaggagagatggagaagaagtcggctgtggtagcaatggagatcagcagagaggatggcggggactgtgcgtgattaatttcccaagactgaggactcagggaagctggtgatgtggccaagcagaaatgtggctgagtcaggctgtggcacagaaagtcttgatctcggggaggaggttggggagaaggttcatgtcagatgagcatggtgatggcttgaattgaagtctggaggtgggtgactctgagagattcaggagggagagccctgaggctggtgggacagctagggtgccaaagtgaggagtaggggctttcgaaaacataaggagggagtcctaagactgctcacgggggagagatggacagttggtggggcagtggagtggtaaaggaaagcagcgggaccatttataccacatgtatgcctctccctgagcatctccttggtgccaggcccggggagcaggccagatcaggtgtaaatcctaccttcatgggcaggagatggagctaaccaaagaataatgaaaatgcacataaaaccacgggcaggggttgatgagataggaagctaggaggaagtgaagaaccaggggaatccatgtgaacagaggacagaagaggccgacagatgctgagctggggttgaaggaagaacatggtcctctgtattagttagggttctccacaataactgaatccatccatccatccatccatccatccatccatccgtctatctatctatctatctatctatctatctatctctctatctatctatctatctatctttctatgatttattagactgactgactatctatctatctatctatctatctatctatctatctatctacctacctacctacatacctacctatctacgatttattagaacgacctacagaatgtggtccagctaatccaacagtggctgtgtgtgaatggaaggaaggtcccatgaatcaagcagttgttcattccatgaggctggatgtctcagctggtcttcaggatacacgagaatcttgaagtagcaggctccaatgccagtgaaggaatgaacttgatagcaaggcaagagcaagcaggcaaagaacaaaaatctccctacttccatatccttctataggcttctggccccagattagaggtgtgacttcccacctcaaagatccagattagaagtggatccccaatccatcccataattagcctccaagcaatggcaccattgcatacactagcaagcctttgttgcaaggacggtgatatagctgtcccttgtgagactaggccagggcctagcaaacacagaagtggatactcacagtcaactattggatggatcacagggcccccaatggaggagctagagaaagtatccaaggagctaaagagatctgcaaccctatcggaggaacaacattatgaactaaccagtaccccagagctcttgactctagctgcatatgtatcaaaagatgacctagtcggccatcactggaaagagaggcccattggtcaggcaaacgttatatgccccagtacaggggaatgccagggccaaaaaatgagaatgggttggtaggggagtgggggggacgacttttgggatagcattggaaatgtaattgaagaaaatacgtaataaaaaaaaaaaagaaaaaaaaagcagagagaatatccaaagtaacaaagttaaaattgaatggtggtggtgggggggaggggcacaacgacagatatcaaggaattgtgatgacacactttattcaataaaatttgaaaaaaaaaaaaagaagtggatccccacgtcaagttaagcaaaaaaaaaaaaaaaaaaaaacaaaacaaaacaaaacaaaaaaaaaaaaacaaaaaacaaaaaacaaaaaaaaacaaaatcctttgcaggagtccccctcagttcttgggttttacttaattccagatgcagtcaagttgacaattaagaatagccatcacatcaccaaagcacacattggtgagggggtatcagatcagtagatctgcttgagcagaggccctgtggtgggaaggggcacacagcatatgtgaacagcaaacgtggggctggagaaggcctggaggtggggactgggaggggtcttctgcagactttactctgtgaaggatgctgggaagtttccaggtaattgtttcaagtaatgatgaatgaccagataacttttgtttctttatttatttgcttggctgtgtgtatatgtgttcagggtggtgatgtgtgtgtgtgtgtgtttatgtgtgtgtctaattattctctcccttatgtttgagacagggtctctctctaaacctggagctcaccaattcagctagactggttgaccaataaacctccagggatccccgtacctccccagcactgggatagtatgtgcacgccacggcattgggcttttacctgcgatgtggggatcagctcagttcttcacgattacacagcaaacactgtccactgagtcatgtccccagccccacattaatgtcttgaaaggacaacattggctgcagcctttagagctgactggggcagagatgtggcactggttaggaagccggtagtcaatgtaattccaaaccttcaatggaggtggcgtgggtggagacagggacagagagacagagactgaaggatcgacttgaggacgagatgggggatgaaggccagtcaggatggcatggctttagtaagggacccaagtatcaaggccagcttaggtcctccctgcctcccaccgagcacttctgaaatgaggattgctggatggagagaaggtggagagtgactgggattctggtgttggccttgctgaatggcgatgtcagcagacaggtggatgtaccgtcctggcccatgcagcaggagtgtagagatgtgacttatgttcgtaggtggctagtggaagtggatggggcctagcctcaatgtcaagggacttcaaaagttaacagtccagaaggaagcatgggagagagcggcactgggcgaaggcaggccaggagagcgatctgcccacatagcaagaagagaggtgtacaaaggctctagcctctcatgctaatggggagcccagggtgacagagctcagaagtgtctattgatattgtagccacaaaagcattgtgacatcagaggaacggtaggtccaacctgggatcttgagctcctatggtctttggccatgctgacagctcagggtgggggcatgctactggtacctaaagacagaggctgggggccaggtttaagtggtttgtactgcctagaactgcagcctacaacaaaggcttatcaggagccccttgcaggagagtacaggagctgggcacctgattagcatagaggtggcctgtagaacaacttctcagaatttggctagagctcagaagtgaaaaagagagataagagaggtggatggtgattagagggtaaggggagctggtactagcaagaaagcattcttagggccagcaggaagaggctttggaaaggagcaggaggatgaggtgagaacaccatccatacatgcatttgtagcacctctgtctggaaggttctgcagaagccgctgagtatggaaaggggcggctcagcacattttccatcacctaagggacaacccagggtaggtgggtgtggtagactaattaattgctctttgaagattaatagtgttcattgccaagttgacaagatctggagtcacctaggaaacaagtttccaggagattgttgagcctgtggggagaattgtcttgataggttgatggatgtgggaagacccatgggtggtggcattccctagacagggatgcttgactgtatacagtggagtgaggtgagcataggcactcatccctctttcttctggattgcaggtgtaatgcaaccagctacctagtgctcctgcccatgtggcttccctgttatgatagacactggggctatgagccaaatcaccctttcttcttcttttttttttttttaattttttaaaagaccattttattttatttatatgtatacactgtcactgtcttcagacaccctagaagagggcatcagatctcattacagatggttatgagcaaccatgtggttgctgagatttgaactcaggacctctagaagagcagtcagtgctcttaaccgctgagccatctctccagcccccaccctttcttcttaagttgggtttgtcagtattttatggcaggaatgagattaagataggtcccacagtgtccccattcttgtcctcagagctggtgactgtctttcggtggcagaaggtgctagcatctgtggttaccatgaacatcttgagtcagggagatgatcttaggttttctggctgggttcaagataattacaaaattcttccatggaggaagcatcagagtcaaatcagatgtggggaaaatggtttctgttgacctcccagaaatggaagggactgggaagtgttaggtctcaaagcctctctcttcctctctggctctcttccccatcctttctcatggttggcttcagtctgcacccttccggatgcccctgcctgtgctctcccttgtatgtataataaagacctcagccctttaggagcaccctgtcctctctggtcttctcatccaggaggcaggcatgctggctccctattgacgtgacaagacaggttcttgatcagaagaggtctgacctgcagaattgtaaaagaatacattggctttgttcagagagagagagagggagagagggagaaggagagttagttcagcaataggagacttagactaacagaggaggcttgtgggtcagggctatctgctacaatcagtgtcttcttcatttgctcccactacattgatcaaggcagtaccttttgctgactctgtagccagcttttgcctggatttccctggctcgccttcctgagtactgccacacctgcccagctttcacagagtctggggacatgaactccacctgtgcagcaagcactttatccaccaagccccagtaatctctttattttccccgtgtttgtccctgactttgattactgttaccaccacagggagctttgccagaaggaagattttatttacttagacaatgagtatctgtcactgtctagtgacaagtagtgataactgatattgcatagtcaactcttgtgtgacactacctacctcaatgtcaggaaacacagccaatcgctattttctgtaatgggcaagatgagaaactatcccgttttgtggatcgcagtgtctcttgcaaggacagatgtccttgagatggtgctaaacccagaatgtacgcaggtcacctcctctccccagcatcccagctttgtgtgtgacacagtgctctgtgcaggatcagttgtcccatgtgactgcaggggtgccaggatgtgactcggtgctgttggaaacccttctaaagcacggtatggtacttcgcatcctcatccattgtttgattttttcccctggccatttcagcttgcactggtgtcacctgcagggcaggcaggtccttctaggtttgctcaaggttcttcctgctccaagccatccttgtcagtcccacctcctacacttccaaaggtctactgtaggacctgatgatgccctttgcttccctgggagagcctactcctcaccctgaggaaggggtaggtggttagtactgatactgggtccgtgggatcaggtgcccctcccaggcagaaccataggacccttaagggggagcactgtctgacatggccacagggctctggacagttcagatcctggttcttcaactggctggaagtacggctttgagtttgtcatctgttctctcagtggtctagcttcaacgtgtgacacaagcacacagcctctggaagacagaaacccagggagctagaagtattgatgttcagtgagcctggcgcctgtggtgatgggcaggtgacaggctgctttgattgtccttggctaacttcatgtggcttcaggaagagagagagaagatgaagtatgtaagattggatataaggtctgggtttgtgtgaacaggcctcatttaacacatctccagggccacacacacacagacacacacacacacacacacacatgcaatattttatatgtgtgtgtgtgtgtgcgtttatggcaatgaatacacagaaggaaagaaaatccaccccacagcagtccaacagttctaggaagcatcagaaatcacccaatgctaagaggcggaggcagagagtctggcagttgccgagggctgagttacagggaagcaaagcaccaagtgtctctcatgtaagacgacagtcctcgaggtcactgtagagctcagggcctggaacagtgttgtgtcagggctgccaagggcagtgtggataattcatggagtcacaggaacaatggtctaaggcagaggtaggtcgggcatgggttgggctgatgtatcaaggtgtgcacttcttcccagactcctctagggcagactgttacaagtgaactcccagtgggtgtgacagacccctggaagttgactttacaaacacaaattttatcaacagcagtcttagaacagtaaaaggaagtcctcatggcttcattggaacgatggtaatagactaaacctctgaaactgtaagcaagccccaattaaatggttttttcataagatttgccttggtcgtggtatctctttacagcaatagaacagagactaagacggtagttggtaccgaggcctagggtgtcggtgtgacaggcacgaccatattgtttgctggaggatatagaagactttgggcctttgggctaggagagcgtttggatgctttacgtggggcttactgggccactgtgagggcctagatcaagaagttttatagggaaagcatattaccaagtgtcctagaaacctttcctgtaagatgttggcaaagattgtagctgctgttatcattgtcctaaaaatccgcctaaggttaagttgaagagttttggattaatggcactggcagaggagattgtgaatcttcactgtatgtatgagttattagtaatcactctggcagacccataaggagaaggagcaaactgtacaaccagaaatccaaaatatgcagtttgaggagagagggagcagcaggaaacgtgatactggagccaggatctgtgctcagggggaacaatgtgtaaagaaaaacccgatgctaaaagtaataaagggcttggtgacctgaggataggaccccatccagccaaggtcctaacggatgagaaggaaccagtggcaagcgtcaacagtgaagggaagcatccacaacagagctgatacactgccattctgagaagggccaagtgcttgccccagcaagcagcagaacttggcagctttggctacatagttctggctttagagttcaggatacaagaaaggggttgtagaatctcctttcatggctacggaaagttgccaaggccaggcatatgtgaggggtatccctacatggaggcctagagagaccattgtgtgtagctgtgaaggtgaagcctgggtttgccttggagatccccaaggtgttggttatgtcagagtcctgggagacttgcagaggagagctgctaacctcttaggttgggacccagcctaagagaagtgtgttgaggtggacaaagctgaagggatttagagatctgaagaccattttgacctcagccaaggagatgcagaatttggagttcattctgctgagctgtggtcctgttttggcccagtatttcccccccaccccaactgcttccttggctcccttttgcaatgataatgtatgttatatgccattgtatgctggaagtaggtgatctgcttttgattttggttttacagggggttacagttaagagatggcatgaatctcagaagagactttgtacttttaaaagagtgttaagactgtgatagactatgggaatttttgaagttggactgagtgcatttttgtattaagatatggctataaacctatgggggcccagggagtggaatgtggtggtttgaataagaatggccccaggatcatatatttgaatgcatagtcaccaggaagtggcaccatttgaaaggacaggagagattaggaagtgtggcttgttggagaaagggggtgggctttgaggtttcaaaagccctgccaagcccagcatggctctctctgtctgcctatggattaggatatagctctcagctacagcatcccctgtcagcatgccaccatgcctcccaccttgatgatgatgtgttaaacctctgaagccataagccctcagttaaatgctttctttcacaagagttgcctagattgtggtgtctcttcaaagcagtagaacagggactaagatttctaagtcttcaccattttgtccctaaagcttgtcactctagctgctcctctgatggcatgtactgaacaagcttgaataaagaaaatcctggggctggagagacggctcaggggttaagagcactgactgctcttccagaggacctgagttcaattcccagcaaccacatggtggctcacagccatctgtaatgggatccgatgccctcttctggtgtgtatgaagacagcaacagtgtagtcatataaataaaataaatctttaaaaagaaagaaagaaaatcctaaatggcagtaaagctaagccaggaacgtcccccaggaagccttttggcctgcgccagccaccatagaggccacagaggctttgggttgcttccgtgtccttcccagcacagttagatccctccgctccactgaagctctaaggaaccaaaaggtaattagtaccactctgtgttgactcgcatacaccacgcctcaacctagaattaacaacagggaattttcctcaatggcagtcatagtcatgatgctaatacccaccattagccttttgctatgctcaaggctgcaaggctgcaaggctgcaaggtggtgttaccgagacaacttgccggaggccacacatgcatgtcctaaactgtggaggtgtgacataggtgtgcagtgttggtgtgaggacggaactcccgggtatactagggcatctgtcacctgggaactggtggaggagggggcctgagctgcaacacatatgacctgaatatcttaaacatgtgtacttgtgtgcacatttgaattattcatttactttatgtatatgagtataccgtagctgtcttcatacagaagagggcagtggatcccttacagattttgtgattgctgggaattgaactcaagaccttaggaagaataatcagagctcttaaccactgagccatctctccagccctcttatctctgttttgaaacaaggtttctcactgacctgggtgtgcagattggctagcctggctggccagcaagccccagagatcttctgtccatttccacagcattaggattacaaggttatatcacgatgtccagctcttttatttgggttctgaatgggagagaaagaaaaaaaaaaagaaggaaggaaggaaggaaggaaggaaggaaggaaggaaggaaggaaggaaggaaagaggaaagggtgtgtgcgcctgggaatggtagaggagaaaatgtagataaaagggagagcagaggcagggacatccaggagagtccagagtgggtattgccagactgagctggatcatgaggggagagggaagaggagagccaggtacaacagctaggagatccaaaagaggagaggtaaattaaaatggctggattatacaaggaaggacaacccagcccacgagctggagaactcatgggagaggatggggtatgccagccataccctgtaccaggtagggactgagggatgctgggagagcccaactgccaggttagcatggatatgttaagcaggcacctcagcagcttgtccaagggttggagactagcagaactcaggtcttcacgcttgaatggcaaacatgataccaatgaggtcatcttcccagcaccctgtgactgagaagtataaagcacaaatgcagatcaggctcatacagataagtgaggagcaccccacttctctctcctcctctagcaataaagcggagttgaatgttggcagagtgcagcctgggtccccatagctctgtgctggtgaccacctgctggtaatagtggagcatacatgctggattgtggagtgtcaatgctcttgatacacctggctcacagctcctttgcccgtagctgtgacagaatacgtgagccagtcaaggtaagacctgggctcacagttccagtggtttcagtccctgactctgactgctttgctttgtggttgctgtgaggcagtacattatgccagggagcaccaggaagcaagttgctacaccatgtggcccctagaaagagactggccttccataagcaccttgaaggtcatgtctttgtgacccaagacctcccagtaggccctacctcataaaggttccatcactttccaattacactgagggccaagttactaactcagggtctttgggggacaatccaggtctaatatacacagatgtaatgcatgcaagctgcacagccattaccagcagggggtcacacaccagcacccaccacacacccgtgctaataggaccggaggatctgtgtggcactccgcagtgtggtaaggcagtgaagagtccaaagttctgaggggtttggttttggttttggttttatgtttgcttgtttggttggtttttggttttgtcttcttcttcttcttttttttttttcaagacagggtttctctgtataacagccatggctgtcctagaactccctctgtagaccaggctagctttgatctcacagtctgcttctgcctccagagcgccatcatgcctggctctgagtggtacctcttaaaaatgtgaactgtgttgccttgtaaggtataagagggttgtgtcccacagctggttgagggaagcctagcaaattaattgttggccccagttggtacaggctgtcctggtgtacccactcatcccttcttttctaacatgtcaacactgtcacgttgtgggtgggtttttgcccttgcttttcacttaaaaggctctttgttccatcaccctccaatcaaccaggattctaccatgtatatacactaagaaaggcagtgggggtgctaccggggatggcagagccctgtgtcttgtctccactccttagacctggtgagggagcctctcgagactcggagctaaccaacacaccatcaacagaaatgttctttatcactagggtctggagagaagtaatgggtgtcatgggagtaatcctgagagtccagggctgtggctcaaaccaggagctgcagaggtggcctagtctcagtcccacagattagaagggaacaggtccccacagctcgtcaaggaaatgcttacagcaggatgtgtggtcgcttggaggccacttcagtgagcattagttactactgcatgtctgtaactaaatgcccagtagaaaagaggaaaggaagaaatgctgattttagctcagggtttcagagggatttcagagcatcgtagcaaggaagtgctgcagagtgtatggtcttgaaaatgtctcacgtctaaagcacagggaggggcaggaaccagagtctgtcacctgggcccctaaagtcttcaaatatagtggcaccagcaggggaccaaccacactgtcaaagcacaagcctgcagggaacagtcaagactaaactgtaatattttctagagttttgcaaaagatctagtattgcatattgttcttaggagagaaaaatgtacgtctcaaaaatggggtgggggaatcttccggctccaggatgtgctgagtatgtcctgtcagggaaaaagtggaaaggagttggaggctgagagggtctttatttggaatttgtaatgtttatttatttggagtgtgtgtgtgtgtgtgtgtgtgtgtgtgtgtgtgtgtgtgtgtgttggttagaggacagctttcaggaactggttctttcctatctgcatctgtgatctggggattaaactcagtttgtcaggcccaagtcttagcgcctatacccactgagtcatcttcctgtctcaactagcaattttgggggagcaaagggaaagatctgagctggaattgactggtgtgcattttgtcggcgcttgcggtcagctacgttatcctcttataatttctgcgtatttgaaatgcttcatgagtgtgatgcacttgagctatggaaaggaggttctaggcgtcgtcccaagctgggctgatcgcccctcagagcaggcgacagtgactgagggacacagaggctgcattatactgacttttttctttactatgacaaatgcctgacataaatgctaaacaaaggaaaggatattttggctcatggtctagaaggttccggtccatagtctttggttccattaatgctgggcctgtggtgaggcagaacacggcagtaggagcctgtggaggagggtgttcacctcacagtggacaatcaggcagagagcaaggaaaggactcttcacagcattctctaagtagaattcaaaacggaatctcctgttgttcttgggagaggaaaacgcatgtttcaaaaatggggtgttctaaaataagcatcgtcatccggaaaagcatgcgctcaacacagacacaggagcctgatgtccacagttcatgttcagaccataacaggccagagtcagtctgacaggtgggcagggctcaggcgtgcaaacctgaccagaaatgaatctcatcagaagctcaatggataaaaccttgagatcacatgagtcacatggtctgattacaattgacaacagtttgttctgccattgttgaggagaatggcggaatgctagcgccagtgtcaaggggcttgtgattgctctgctccaccaagtcctcagggaaccagcctcgatctaaaaagtttccacaatcaagtgtgtgttgtatgcaatttatacctcaactaagctgtggaaacaaagaggaaggatcatgtcactgtgaaacccaaggagacaaatgaaaaagagacagatcttcaaaaagagtcagtaacactgaaagtgaaaaatatcaattgaatgaaagatactcattacaaaggaagcaaagccttgggcacagtggtgagtgcctgcagttctgcacccaggaggatgtgtgggaggattgaaagttcaaggccagcctaggtacagagtgaagggctgcccccaaaattttacaaaccgaaacgaaaacaaaacatcagaaaagcaagagaagtaagaaaggaaaaaaccccgatggatggaagagactggagtaggcagagaaagcactggtggcctgaaagagagcagagaaatgttccctgacacggctccgaacgacagaggaaactatggagaagcagctaaaaggcatgggggctgaatgagccattctgtttatttaatagaaattctaccgcaggagagtggtgtgaaggagaggttgtaccgaaaaacacaaaagccggggatttccaggaagtaaaatgtggacgtgctcattaaggagtgaagagaactttataatctttgcttcacaaataatgcaaaatgatgccaagtacacaaatcgaaaggctatacactgatcacctacaaaagatccatagtagactaacagtaggttgcttataacttgggtcaggaaagaactagagacaccattagataagctgacacccgtgctctctgatgaatattcctttctgagtgtatctctcttcctgctttagacttcaagcttaaaatctatatcagaaatgccttttaagggctcctgccctccacaaagaaagtaagggacaacctagaattccatggatctcgatactcaaaatgatagtagagtatagacatttggacacaaccccaccccaaaccccaagggtcttgagcatttgagatttcagcagaggatgaaccctttcaggtcactcgtgcctgggccccagtgacgatcttcacctcctacacacgcagcagagaaagaggctgccttcagcttttgtcacaacagcctggcacctgtatggagtggcaaccctgggccaggttacccaggatcctgattcagtcagcacggatgagagtggcgtcccttctcaggtcgtctccagggtctctaagacaatgggaatgggtggagaggagacagcgaaacttagacagcggctgaggttgtggtgggggccatgtaggagggcagagggaagaggtgagatgggaggatggagctggctcctgggcctcaggtagggagcccaggcacgtgcgagccccttctctaatggcccacttcagacagtctctctgttttccagattgtggacaagaacaaccgctacaagtccatagatgggtcggatgagaccaaggccaactggatgaggtgagtcccatccctgccagctccagtgagcctcaccagcctctgggctgggcccaggaagtatcttgggcctccaggatctcagagctctccaggctgctccagaactgcagctgacagggtttgaaagaagtgttctgttccccaggcttccatcagaggctctaaagagcctgtggccagaccagcaggctgcagggatcgggctgcatgccatgactcccagtagaatcctgcaaagaggaaaatgtccccaacctaggttggaccactaacatttatcctagggcagattcttgttgtctggatgacatcattccagggaagacccagaagtcatcctatggttttatgggaatgaaggtttctaacatctccagctcccttccctatggggctcacattaaacttgactgctgaccagcatgggtctaccctggccaaggctgtggcctaggactgtgtgtcagaagcatccttaaagtctagccagagagagcagagaattgaacaagggtcacttcccaggtggccacaatgagttggcatccatgctcagagctggcctgtgtggtatgtgtgggtcctaccagtgggtgtgtattaggaaaaaagtcagtttaactccagtaccacttggtggcctggatccatgggcaacgatggagcatttagatttgtttagaagaaaggaagacctttgaggaccagagacccagctacatcatgaatcgaggccctatcatgtatagttctgttcatctcagatagcagatgggtgacctttgggaaccaatgggtaggtgagagatgggggcagcaagagatgcctcaggatgtctgagcacatgaagaggacctggttggaagtggaaagtcatgaggaggtcccctgtgtccttctccgtggcttcactgacacctgtatgacctcagggctgcggctggtttgcaggacagttgggctcatcctcttattgagagtgcagctgtttccactgcggcaggcaggtgcagaatcagcgcccacatgtggcctcctcctctacaagatggtctgctatcctaaaagtggcaccagaagttgtacttgacgctcctagctgccgtcttctctctctgccctgaggtccaggtcagcttggcagtgtctcatcccttatgctgggcatctcgtcaactcagtcacattggaacatatgagagtaggccaggtcagccctgccctcctctgctctctgcacctctacaggcatgcctgctattgcataaatgccagagaggctcagacatgtgctgtgtgggggtccagatggaatagggaggagcctttgatatgtgccttctgagggtccaggactttgttgaggacagctggagcaagtgggcatgaaccttgcagaaagactgctgacggacagcacagccctgggctaggccttcgcatgcgtcaccacagtcaggtccaggcttgctgaaagagtgaacctgatgtatcctgtgacactgttacttgcagagctccagaagctatggcttagagagctggcctgtcccatgtgtcctcccatttctgagcttttgtttggttgggcaaagggttttcccgctgccccctagaaaatagtgcctcatctcaaccatcttggccactgtttagcacagcagggctgctggtgtaacttggctggggatgggtccggagcatcacgattctgcaagttcttgatggtgattccaatgtggccgctcaggctgacagccgttgtgctggtggtcatgccccagtgacaaactgagacccagagcagggcaaagtcttgttcacattcatgtcacctgtggcaaaatgaggcctggggtcctgtgtctctagctagacctgcaagccacagttctttctgataatatacaagggaccaagcagagcatggctccttatgactgtgggtgggttccgtgggtgggagactgctgcttcctccacctttgttaatatgactctgtcctgctacccctagcctgtcctgaccccagatgactctgggtggtcttggctgacgtgtcctgagttaagaaggttccaggagctggtgattgtgtttgtgtgtggctttgcttttgggagctcttgctaatttacagactcttagttgtgttgtcaccccagggctttgggggtgatgttgtagatcgacatccttatgaaattactggtggacccagtaaagagtaggtacaaaggtactcatgtcttgagtgttaacctgtgcaagctctgtgttaggtgctctgcatgcagtaagtctcagcctggggcatttgggacgcatgggcagtgctttcagacgttctaggtaagcacagcttcatgcgtgggtactcctggttttgcaggagtaaaaggtaagtgtattattgaacattctacactgtacagtaatctcctctcctgacccagactctgatttcccatggcggcgtaattagggccctataggcttcactctagtcttatagaggccctgtggtccccagggatagtctcaagtctgtctgagctcaaggcctttgtcctgagctgggtatcgaagccgcgagctttcctttgactgattacacgcgcttggctgaaaggactcagaagtaagggtggaggaaccgagagctgctggggcttctgtgattctggaagcatccagaggtgtgggttgggatccgagttagcctcaacaccctgcttcctcctgggtggaactcttgtttcaaaactatagcaaaaggcaggtagaaccggaatgctctttgaattctaaagccagagcaaggtcaggttgaagaacctcagcagaatcagttatcctggtgcctttgctagggtagcatgtctcttggtggatgctcacgggtgcctcgcatcttaactagaataccacagcagccacgccatgaggaaggagcctgtggtggtgcccctgagggagaagagattgttcttctctgaacatacatgttcagaagtagggacatgagagacactggaagatgggagacaagtcacaggtgacagaataagctttctgtggttgcaacatgatggacaccagcaaccagtgccacagccactgcaggccactgtaggctgtgttttaaactcacttgatgtgtgtgtgtgtgtgtgtgtgtgtgtgtgtgtgtgtgtgtgagaagatgcccaaagaggctagagaggggcaacagatccattggagtttgaatgaagggcatttgtgaattacctgatgtgatttctgagatccaaattctaatactcagcagagagttgtagtaaatgtccttaacccctgagctgcttctccagtcccttaagtggttaaagctcgtgtacgtagatggaaccctcagaaactggtctggacggggagaacgaggcagcaaaagctgagtgaacttgaacttcctggtgctcaaggctgatgagaggtagggcagcctaccctgcagtcactgggctcctactacctccttcctgccttccctctgaggaggcatcgctgtaggaggagggtgtggtggggccttggtggccccagatgtcccctggcttcccagatggggccagtgattaggaaggaggaccatcctcattaacggtcatttacccaattatgctttgtgggatattcaacccaaggaacgtgctgcccctggccgagcgtaagaggaagcctaaattctccaaggaggagctggacattctggtcacagaggtgacccgtcacgaagcccttctctttgggagagagaccatgcggctgtcccatgccgacagggacaagatttgggaaggcatagctcggaaaatcacctccgtcagccaggttccccgctccatcaaggacattaagcacaggtgggatgacatgaagcgcaggaccaaggacaagctggctttcatgcggcagtcactgtcgggcccagggatcgggggccacacctaccccatcatgctcgctgcccacgagagagccatcgaggcagcactgctcaccaccagggccgggcatggcttccccagggcagagctggacagaaccgacagcccgtctaccagctgtgagtatcgatgccgagtgtggggcttgcttcctcgtgtgcacttattcccatgctagctctcagccctgcctgtctccctgactctctccatggccccatctcgcttctgtcttgcctccacttcttgctcatccactgtgtgccagaagcccgcttgggagcaggaaggacagggctgcatctaaaacctacacagacacttgtcggactaaataagccccaggtggatccatcctgtggcctaagggttacgtgcacatagctatgaaggtggccgaacccaaaccataaccttgtttaaaacagtacaagtgttttgttggtttgtttggtacctggagcagaaactgtggttgaccttgtgttacagtgtcaaaaggttagacgtgccttcttggattagattattgttcaccttagaggaaggataagggctcacccagtccaggacatcccagatttccagctttgagcttgtgtgatctccaggcctcccaccctgggcctgctgctctgcagtctgtgctgggtctgggacacacatgaatggagggctgcagctgtagagaaggcctgaggctggctgaggaagatgtttgaagggcgaggaagagttaaccaggcctggtgcgaggcgcagaggaggggaggggaaggcgagcaggctgggaacagcatgtacaaggcccacatcaggaaggcgcttggcacgttccaggaactgcagaagccagggaagccccatcctagccagccggcagggggaggggcaccaccacagcagccgagtggcagggctgggctgggccggggagagacctttctccgtgactctgtctgctttgtccacttctctcccgtcttctgagcttgatccacttctctttggctcctgcttcttggtgctcacctgggactggctggccctgctttcttgcttcctgggacttttagcggttctagctgttctagctgtgttcaccaggagggggagccatcggagtccatccctgaagaactatcccctccctcccacttcttcacacacccatacccttcctcatctgctgtcctcagtggagtcctgtgagcagggcaggaggatccaaggaggctgtggggccgagcattcagccagcgggagagtggttcaccaagtccgacttcctccctggccctttgccgcggggatctgcttatttcctgtttggctgaggtctctgacaggtggccactcacaaagtcagcctcgggagtagaaaagagtggtcatgatgagggtgacttccttgttaaccagatgaggcaaacagtcttccagaaagtggaggtggccctgagacatcagaaccagacttgggcctggacctgccagggtttgctaaaacctcggggcgggcagcatctggaaaagcctatttcctgaatcctgccctgttcacccctccgtctcctagagatcgaagatgatgagattagcagaggtaacatggactgcaggggctcccaaatctactaactaatcacaagcttagcctggctgggaccgtagtggcctcagggcttggggaaagggtaatggccgttctgagtgctcctttctaccctttctggcatcccaagaggttggctgccacttatggagtatgctcaggaagcagtaggctccactgcgccagcatcaggagacccacagatcagtgtggtcagatcaagcactcacgggtgggccatgatgtgcctgacctcacagcccacatcagggggacaacaaggctggtggctcgccccacataatcctgagtcctgcatcagcccttccctctcatctccagccatttggcatctccctgtggtggtttgttaggattccagcaaggccacaaggtggccccaagcaactttgaaaagtccctcccttgtggagaccagtgctcacaagagagcagcttagaacctctcacagggatgggtagctctctcagctctgcaatacaccgtagggtctgggagccccactaagagcccagccggggccccgggggttcagcagagcagtcattattgtttctctgaaggtagtgaaatgtaatggcacaatcgtggtcatgagcccttaggctggcatggctgccactggagctggggtctcctttgctggacaatcctttcctggaatgtagctgcctctgtgggaagaagggaaccagctcccgctcacccttctaccgatgctggacctacacgtcccagggacttagaagctggcatttctctgtgtgtggtgccagtgtaggctgacgggtggccagcagggacttttcaaagctgtgacctgtgacctgggctgccccctccacccttttgtaatcacctgtccttctctccttgtctgatccaagatgatgaagacgaggaagctcccgggccctcacagcagcctctccggatgcccctgcttcgtcctccagaggaagaggcccccctggccaggcccacgctgctctattcatcttcctcagacccatccaagatgttggaccctaagccagaggtcctgccccatccctcactccaggcccgcaggaccccagaaccacatcccagctcgcctaccctgggcctggactggcatctcctgcatgcccatgcccatcagactgaaatgttccagaagttctgccaggagctgatgactgtgcaccgagacatggccggcagcatgcatgtcatcagccaggccatggctgagctgaacagccgtgttggtcagatgtgtgagacgcttatggagatccgagatgcagttcaggcatctcagcgtgggccagaaggggcagcccccatggaccacactttccagtctcaggcacccctgctgggccctacaccagcacccccagaaccagccccaatacggactaccaggtctcggaagagaaagcacaatttctaacctggccagtttgcctaaggagaagcaatgccggtggtgtctggccttgagttgggggagtctcttgtgtccagaaacaagactgatgaccgtggggcacagtcgtctcttcacctggtgcagtccagtctcctgtgctttcaccgagcgggtgtacaggcgcaccacccccttatctcaggaagatactcaagacacaagaaaagctgcctgcttgaatgcttgcttggcctagaaggctgctctcctcgtggcctgtatcctgtatcctatggagcaggccttgctggggcagggggcagcatccaacagaatcttgctttcaactcagggctgctgcagagctgacctcccaggtcctgattctgccctttctcaggtggtgcggggctgtgggtgggcggggctggctcagctgggtgggtggggcccggccatggccctgtgcttgccctgcgttgctcggctgctgtgcttgcctttgggaggggttggtggggggagaagaatgggatgtgctggtgaggggaaagagatgattttgcattcttagcatactataaacttttccccccccccccccgagcctgcacatggcaggccatctcaggaagccaagtcagtctttacaatcactgattactggtcattccagtcattgtcatgcatctcagggttcagaaatgatacagccatgatagtggggacctggcctgctttcttcaagaggccagatctggagtactaataatagatgaggatcctgctcctcacctaagctctgcctcagcttctacagttagaagagggaacaaaaccagcgtgatgagtatgccagcctgtgatggccttgagtctcacagccaatgaaggggaggttctgggccctggcctcaggagccagcaggcagactgtccgctcactggctcctaataaggccataaaccaatgagactgtgtccagtccagctcccagcatgccttgcctctgcttgcttgggctgtatactcacctagccatacagacttgtagctttgagttttgtttagggggcccagtcagagagctgggatctttgagtgagggaggagaaaagaagccaaaggcttcactctgacctaggtgcagctttgacctcgatccctggcctgaggctgaccccagcagacctttcacaccctaccctttctccctaagaaacagagtggacctggaagcctactggacccagtgctcactgaggctgttgctagcgctgtttataaacacacaccatgcttcgtcctacatgagatgatggacggatggcacctgctgtgcccctgagccctgggctccattgcctcaatctgtggttctttggtggttcctgccccatccatcagactgcatattgtcttgtctagtaatagcctggtgcctggaattgccccgcctgtccatgctggaacccaagttggccttctcaaatattttttgttaagatggcaataaaatgaatcagatgtcacactttgaacacagccaggctccaggatctttttttggtgtgtattctctttcttcctatcccagggaacccccatgagcctccagatcagggattagatgcctaatggaaagtgtatggggaagaggtccctgtggaccttgcatattctggattccataaactccctaggggcgtgctcaaccccatgcttggccctccaaacgaaaggcagtgacttgtaggccaaaggcagctgaacatccatggatgtcaacttttaatttttcctgcacatcaaaagtaaatttaaccttatgctcccccaaagtattacagtttccagggaaggaaatagtttctggctggagacttgagaggctcctggctgtccattaggggttatcctgggatactcctcagtagtggctacatctccactgacctcagtagctgcctgtgaaaggcaaggccctgcctaccaagactcctcagaagaaccagagttcttcctcttggattcactggagtgtgcctcaccacagagctgtgttctgacccgtcagcctggctaacctcctgtcatggagagagcttccgtgagaggaatcctcaaatggtagcctatgatgtactttctgaatagttcttagctacctttggctttggaatccagatcattctcttaagttcctgaccaaaatgcataaccatggaaattaagattgcagttggcaggagatacagagatgcagctggcctgggtctcctctaatacccaagacctgtgagactggttggcctctatttctggtgttggggaagaagaggccacattaaaggctgtgtacaagaaccaaggtcagagtccagggacagtggtcagtttgagatggaaatggtttccattttggtgtcttggtggcagtggggaccaggaagccagaatatattcaatatattcaataggaagaggaaatgaatggggagcctgtcccagctcttcccaaaaggaagccttgaaaggaagcccatagcatatgtgggcaactgcctggatatcagagacctaacccggtgacatcacagagcccagcttcttgtccagtcttcccatttctgtcttcctgggcaacttcctttctggtagaaagctgcgttggccatgacaggcttgtgtcagtcccattaaacaaagtggacgactccctgagccattttctttcttgagtcggaacccatagtcatttcctgacccagctagaaaatatggtgcacttgataagacccagtgggtgaggcctgagaattgtctcccggtgcttatctgtccagtacccaaggctagtgaggagacaggactcaaaacaatgtgttatcttctgggaagattcagtccagaacccctgcccttcccaccactgtcagtcacctacttatttctaggatgcctgactctgaactgccagacttgaactcagtctctacaggacagcctggacccgggtgtttcccaccctgctctgttttcccaacaagggagtgtgagctaggaattcagaccccctggtagacaactggtcttgaccacaaggaggagacagttcctggaaaccctggggtccttggccacgtgacacaggacagtatttcgtaagaatgagcacagcagaattccgagaatgtgccaagccactgagtgtcgccactgtaaagggaggggacctcattagaggtgatgggtcctgagtcttagctggatgcagtaaactttctcttgaaagttctgtcacataaacatgttaagtcctgggactcggtgactgtgattcacccacagttgccatctgtatctcatttcaaaagccaagttttaaaacaaccaaatgcaagatgctcaacacattttgatctgatgctggaaatactttgtgatctgtatcaagactgagtgagagtgctctctctaaatgctggctcttgttaggtagaaccacattgcagggggaggggggacgaagggaaatgcctgcaaaccatttgaaatggttagacccactccagacattgctgttttgaatcagcaaatcgtgatagtgacttgttccccatgtacccttttctctggcatttaatattgaatggctggccagaaactgaaagggagaagggagaaggtgctcttgggtgttctgtgaaccagtggttccccagagaacacaagaatgggatttctaccttccagatgtgtctggaacagaaaaacttggagctacattcattctgggtcctcctgaccattacactggatggtttgggaccaatcctagactcttgttaaattggaaacttggagctgaggctggtcctgtgagtggagcaataaggctgagcatggttgctgcagtcttggggtctgccttttgtccttgctgactatgttgtggctgggtgcttggagagcctcatgagattttcacagctcatggggttagggggctctctgatgctcatgtaagatacaggtggggatgcaagcgtgctgaggctaaggccctgggcaagacggctgacccagggctgtgagcaccattgatcttgtccagattggaggagcttggtgtttgctctcccactgcttgggtcttcatccctcagcttacaatgtcctctgtcgccagaatggattgttaactgggctccaggggatgtgtttctaaggtgccagcctcctctggggtagtcaagttgattcttcaggacctgtccagataagagcagatgggataggaggtctgcaggcacaggtctagcggtctccagtgtaagttcttggagctgtcagccccccattgtcaccttgcaaagaatctgacatctgtgtgaatgttttctctttgcctcttgagtgagagaagcagcacaaacattattgaggaaacctggaaggtacagacaattccagagacgatccacccaaagtgatggccgtcctggttaaaacacgggtgtgttgacttcaagcagttctgctgggagacacattgttagagcacagtatacttggctttggctccaacctgtctcactctgcatcacagcaacactgttttggagttgggtaaggtgattccaggatgttggaagtgtcatttgaaggaaactgggtgaggggtgtggattcattggtgtcttgggcattgctgagtccatgcgttccgggcccacatggaaactgtgagttgtagctcagggaatgataggccacaaatttgcatcattagctgtgcctttggacaagtttctcagcctctccaagcctttctgttgttgccgatcttctgctgtctctcctttatctattccccctttgtccttattgggccaactataaggatgctgctctaaaactgagctatcatcagtcactcttagaggatcggttaattctgctaagcctagcaaaatatggaaacagcccaaagcttccccctgccctaactgaggttaaaggtcagtgaaagtggagctggagcttaagagcctgctctttcataggacccaggtttgagtcccagcactcacatggtagttcacaaccatctgtaactccactttcaggagatctaatggcctcttctggcctctgggagggctctatcatatggtacacagacataaatgcgggaaaaacacccctacacacaaaatattaaaataaaataagttttttttaaggtcaataaagaggagaagggatagccacctgctattgagtctggggttgactgtgactctcaaggttggcagggcagatataatttccagtctcagattaaacaggttcctagggtccagagaatgtgttaacatgatactgaatagagatgtaagttaggaggaccagctctatagttggctgtctctggatgagacagcagctcttcttatgtgcccacatactttaagctcttgtgccctgcacctaaggcactcaaccaggtgtggcccatggttctcacctgtcccctccccaccaggtacgtggtcatttcccgggaggagagggagcagaacctcctggcgttccagcacagcgagcgcatctacttccgggcatgccgagacatccggccaggagagcggctgcgggtctggtacagcgaggactacatgaagcgcctgcatagcatgtcccaggaaaccatccaccgcaacttagcccggggtgagtatggccatgggaaggagcgagtgtgccctcagggccagggacatgcccataatgctaagtccacaagtctaggtcagtactgattgtgaagtgactcgcccacaaagctagggtcacgcctacaggaccaagaccacgcccacggggctaaggccatgtcaaccagcaaaggttacacccactctgaaccacaaaagcccagaaagcacctctgggaaccttccaagcaaaccaatgaggaatgcagtatcgagcagtgcaaagagccaggacaggcaagacctcagcaaagtaagccagtggccaccccgagggaattctctagtgtgcagtcctgagagatcagcaaatcccaaccaaataaatcagttgaataacaccaatcttgttaccccaacactaactgatgaaaagacacttctcactcagtacctcaatagataacttcctgtgtgctagctgggttgccttcactttgccatgggatcaaggtaatgagaactaacctgccaagatgttctgagagtccgtggagcaatgtacttaccaccgttgatgcaatctctacctcgactgtcactaagtccttggctgtaaaattctagaccagtgattttcgtgacatcagctccaccattgtacaattgtccaaactgagctttacagaaatgcagtgacttacccagggtcacgtgactaatgaggacagagccagctttccaacttgaggcatctgaagtgaggatctaagttttatccagacaaagccagccttggtgttgttgatcttgttcctgggagccaaaatgatacacagcatgaaggaatggtttctaccggaggaaggctagtacaggagaagatgggctcaggctgggagaacatagtgggttggctgtccatccatgtgccactggaatggctcatttaaaaggaacttggcttactccctgcctctggctctccagctgtagatgccatcctcagcctggccagggtacacaggtgcacccaggtccttttttccaagagagccatctttgcacagaagctgtacattcacacacccagagtcaatttggtcctcggaggcagagccatgcccaacgtcttctccgccgtcatcttaactaacctcttcactggatagccttgtttagaagatgagcggaggagatgggagcagatgactcactgaggtgaagatgattaggaagacaaagcagaacaggtcttggggtgcccaaaagctgtctgacttagtcaaaagcatctggcagttgccagcgagctgagagacctgtgggtaagcctatctcctgactcctttggagctgagcttgggccatgctggtttcattgggatggcatgcttctgggataaagggtggctactgtttggcctcttcctgaaattccagaagggttcctgtgggcctcggaacctccagaaatgtttggtgaacctcagttgcatcgataaaagcagaagtgaacgaaaacagccagggggtttccagaagaatcacattacccaaagaaaagaaaaccaagatgggtcacagctgctgtggcacagattcatctctttcccaccatcttggattcttctggaatatgtcttcctgtcttctccaaagcacctcaacctgaatcatcctcaagaagacctgagacccagggacatctcaaagagaggagagagcttggggaaatgaaggctcacaggaagattgagaagagagagagagcgagccttggaagatacaggattaaggtatctatctgcccgtgaccaggctggattgtaggcttcaggaagaaaccagcaaccacagtggacccagcaggagctgtgatggaagtggtccttgagagtgaccgtgggacttggcagctgatggatgcatgctagatgttaggtacagagttctagacctttaaatgtgtcttggatgacctatcagccctgcttagaaaggtccccattgcccagtcacttaaggtattacagctatattagctttgtgtgtgtatgtgtgtgcgtgtgtgtacatgtgtgtgtatatgtatatgtgctatacatgtatatgtgtgtgcgtgtgtgtacatgtgtgtgtacatgtgtttgtgtatgtgcatatgtgtgttcatatgcaggtgcatgcatgtatgaatcagcctcatgtgtcattcctcagtaatcgctttgcttttgagacaactctcactgacctggaacttgaaaaatgtgctaggctggctggtcagtgcacctcaggggtctacctgaacccaccgtcccagcactgggattgcaagtgcctgccacaacacagagctttttttttttttttttttttttttttttggttgtttttaaatgtgaattctggagattgaaacttaagtcctcatacttgcaaagcaaacgtcttatcagctgagctatctgccagtccccccgcgccccctttgtgagacacagtttcatctatcccgggttggccttgaattccatatgaagctgaggctggctttgaactccagagcctccgtctctacctcccaagcactggggccattgatgggcaccactgcatcttgcttttagagagaggagcatcttcatggtcagaggctgcttagccagatcgtacttattgtcgtttttttttttttttttttttttaatgaaagagtgttgtgtggagcccagagctcctggagaggatattctttattcctttgtggttatctttgaaggatacgagtcgacacacttaggtgatctgtgtgatttgtgtggggattataaatttttttctttgatttttatccatgaatgtcgtggaggatttggaatagaagtcatggtgacctttattaaaggttgtccgtggaccagggattttacatggaagccacaagttcagaaggctttcctgctcagcctagaaaacatgggtgactttatcttccattacagagacaatgagagtcttctgtgatgtaacacccagcatcttcaacggtctgatgtctggggagcccaagacgaggcaatagggcacccttgacttttcagagattcagcttggcgagcaccccacctgtcctgtgacacaaataccttgcattacatttttaaaattgaatttgatttatgtagtgtatgtaatgggtgttttgtcttcatatatgcctgtgtaccgcatgtatgccagctgccctttgaggtatcttctgggtaccctgggactagagtctgtcacagagggttgtgagctgtcatgtgggtgctgggaactgaactcaggtcttttggaagagcatccagagcttccaatctctgagatgtctctccagctcacaaaaggcattttttaaagggctccatctcgcccccgagctttctgcagttctgctggcacagatacaggggcttctgggagccgcccgagtgccaggagtccgggatgaggttgttgcttaagcagcgcctgtgaggacagaatagggacttgagtggcttaaaccctgctgtgctgttttctgtgggagcctagaggcgtgagggaagcagctgggggaggccaagcatggagcctcctgaccttcacccagggcctatcaaatcctttcacagaagcctggacactgaacagaggctcaaggttgcagcaccaggaccctgcccaattcaggtggcctttgagattgcgcaaccccacaggttctgctggcagaaccttctgaaggctgggaaacaactctcctcagcatgtcaccccctgggcatcccagcacttctgtagcagtctgtgctggcctcgctaaaggatctaaaatagcttactattggtgatctcaccaacatttcaaggtaattaaaaatgaaggaaagagaggcatcttttgacaggtggggaaatggctgtatctgagaatactttgggtttcgcaactaccttgccctaatcttgagggaggctgatactctggtatgtttaggaatctttcccaaggcacccccacttcttttttcaaccttagccatgactgagaaccacaagactttgacccatctttctttgtgtatttcttatctttagactgctgggagaatagagaggcagcagctgtagggtggctgtttcccttggctctctgggcccatgagcatgggaggaaggcagggcctgtgcttcccccgtgctttctactgaggccctgcaaccaccgtgtagtctctaggtctgaaggatagcttgtcccatggcgggcagacagacactcagctctgaaagctgttgcattagtcagatggagtgagatgctgtctcctggggtcatagtatggcaagccccatccccataggatgatgactccttttcagtctccgcttgagacatatgccaactcacaagtgtagcatttatcccatgtgaggcctttctgtaaaggtcctgtgactctagagcccacgatccgttcttctctccatttgggtctcacctgacccagatggtcagatccaggtggatgtgtcaggcaatcctctcgcagaaggcctgctctgttccctgtcaatttctctgtttggggctttcccccacatcttcacaccctggttttccttcctaggagagaagaggttgcagagagagaaggctgagcaagccctggaaaacccagaagacctaaggggtcccactcagttccctgtgttgaagcagggcagaagtccttacaagcgcagctttgatgagggagacatacaccctcaggcaaagaagaagaaaatagatctcatcttcaaggatgtgctagaggcctcactggagtctggtaacgtggaagcccgccagctggccctgagcacctccctggtcatccggaaagtccccaagtaccaggacgatgactatggtagagctgccctgacgcaaggcatctgcaggaccccgggggaaggggactggaaggtccctcaaagggtggccaaagagctgggcccactggaagatgaagaggaggagcctacatcattcaaggctgacagccctgcagaggcctctctggcatctgacccccatgagctgcctaccacctccttttgtcctaactgcattcgcctgaaaaagaaagtgcgggaattgcaggcggagctagacatgcttaagtctggaaagctgcctgagccctcccttctgccaccacaggtgcttgagctcccagagttctcagatcctgcaggtaagttcctcaggatgaggttgctgttaaagggaagagtgtgcagtgccactcgtgcgcactgtgtggagggtggcccagagcgctctgctctgtcacaaccacctgccaggagaccagaggaatgcaactcagcagaggcagccccctcttggggtgggagcccagtccctcaggtgacagaggcaggctggcttgaagatcgggggagggagggcattgcatgtgccaacctgtatatcctccttgtcaataaaatatgtcccatttgcaggagggctgtgtgctgtgttcttgacctggtgttttctcttgggggcggggcccactgttgtctcccctgacccaacttctctcttcccccagtctctgctgggagcttttacagctccccaaactcaggccaggagcacagcctcgtccacttcttccagactctgtcccacccacatggtgctctgttcccagcctggagttctagaaggatgaggaaccagagaacctggggccgacagctgtatgactgtccttttttgctggctgcctggatctcttcaagttgttggaccaaggaagaactgtggttcgattctgtgcagatttgcagctaagccgggctgtttccctcaggtttcccttctcagccaccctcagaatgggttggggtggacgtaaaaaccacattttgcctcaatatcgaggctgcccgcagttaagagccacatgctcaccctgaccatagcggtgggcattccagggccaggtcctccagtgtaacctgaatgtgtgacatcaaacattctgcctcttctaaaacattccaccccagaagcacccacaaatcaaaactgagctcaggtgcaggcagcgtggagcatagtgagtaacgtccaagaacaccatgggcaactcatggggagggaacctcactgtggagagtagagttacccttgactcaactccaggctgggcttccatctctgtggggcccgcgctccctcagaggcccttgctgagtctgtgctgtcaacagcccacgcgaacttctccttcccctcttattttccagcctcagagagtatggtctccggccccgccatcatggaggacgatgaccaggaagtggattctgcagatgaatctgtctccaacgacgtgatgacggcaaccgatgaaccctccaagatgtcctctgccacaggacgccgcatccggcgcttcaagcaggagtggctgaaaaagttctggttcctacggtactccccgaccctgaatgagatgtggtgtcacgtgtgccgccagtacacggttcagtcctcacgcacttccgctttcatcatcggctccaagcagtttaagatccacaccatcaagctgcacagccagagcaacctgcacaagaaatgcctgcagctgtacaaactgcgcatgcacccggagaagactgaggagatgtgccgcaacatgaccctgctcttcaacaccgcctaccacctggcgctggaggggaggccctacctcgacttccggcccctggcagagctgctgcggaagtgcgagctcaaggtggtggaccagtatatgaatgagggggactgccagatccttatccatcacatcgcccgggcactgagagaagacctggtggagcgcatccgtcagtcgccctgcctcagcatcatcctggatgggcagagtgacgaccttctggctgacacagtggccgtctatgtgcagtataccagcagtgatggacccccagccacagaattcctatccctgcaggagctaggcttctccagcacagaaagctatctccaagcactcgaccgggcctttgctgctctgggcatccgcttacaggacgagaagccaactgtgggcctgggagtggatggggccaacatcaccgccagcttgcgcgccagcatgttcatgaccatccgcaagacgcttccgtggctgctgtgcttgcccttcatggtgcaccggccccacctggagatcctggatgccatcagtgggaaagagctgccctgcctagaggagctggagaacaacttgaaacagctcctcagtttctaccgctactcaccacgcctcatgtgtgagctgcgctccacggcctccaccctgtgcgaggagaccgaattcctgggggacatccgtgccgtgaggtggatcattggtgagcagaatgtcttgaacgcccttatcaaggactacctggaagtggtggctcacctgaaggatgtcagcagccagacacagcgggctgacgcctcagccatagccctggccctgctgcagttcctcatggactaccaatccatgaagctcatctacttcctcctggacgtgatcgctgtgctgtcacgcctggcctacatcttccagggcgagtacctcctggtgtcacaggtggatgacaagatcgaggaggcaatccaggagatcagccggcttgcggactccccgggagagtacctgcaggaattcgaggagaatttccgagagagtttcaatgggatcgccgtgaagaacctcagggtggcagaagccaagttccagtccatcagagagaagatctgccagaagacacaggtcattctggctcagaggtttgactcccgaagccgggtctttgtgaaggcctgccaggtgttcgacttagcggcctggcccaggaacagcgaggagctcctgagctttggcaaggaggacatggttcagatcttcgaccacctggaagccattcctgccttctcccgggatgtgtgccgcgaagggacggacccccgggggagcctgctgatggagtggagagacctcaaggctgattactacaccaaaaatggcttcaaagacctcctcagccacatctgcaagtacaagcagaggtttccgctcttgaacaagatcattcaggtccttaaagttctccccacctccacagcctgctgcgagaaaggccggagcgccctccagcgggtccgcaaaaaccaccgctcccgcctgaccctggagcagctcagtgacctgttgacaattgctgtgaacggaccgcccatcgccaactttgatgccaagcgagccctggacagctggtttgaggagaagtctggcaatagctacacactgtcagccgaggtcctcagtaggatgtctgccttggagcagaagcccatgctgcatgtggtggaccatggctctgagttctacccagacatgtagggggcctgagctccagaggccacaaagccggtgaatatttttttaatctatactcataagctttgatatattatataaatatatattatattatatatacatatatatatatatatatataaacctacactgaaatttttttaaagactaagttaattatgtccaccagaagccactggcagctttcagaaaggagcaatgttggcaactgactcttgtctccgcacttggcagctgcagcctccacggcaactcatcctcacttacacgagcgtgttctggggccacacgtgttcccaccaaacagtcaaagcggcataagctaaatgatgattctcttgtcacttttaggtggcttcttctgtttctgttctcatgtgttggtagagggctgggggttgggtgcctgccttctccttttttggtatggttttgtggcgggggcggggggggcggtgaaactttgtggtctcctcattggcatcctggtccagttacattacatctgggtttccatgagggtgaattggatttctggactagactatctggtctttctcccctcacctgacttcagcttgggagatctttctttgttcattttctgattgattccttcccttgtcccaccgtcaaatggtcaaatgcatcaacctccctccgctgtgagccagctgcgttcccctcccacccccccccatgtcgccgctcccctgtgtcacctctgccaaccctaggttgtcagttcccttcttcaggcctctggagtttaaagatatgagctgttacactgaacgtaatttttttttcacatacgagcttgaaacttgggagtggagggagggtaagctttatgcctccccctttccagccgctggaggataaagtatatacttccattcatatcttgggctgttggggagacaatgagccacgagatctaaactcccaacaggaccatgattcttttggctaaatacaggtaaaatgaaaagtgtatattcaactttcacattgttttcatctttataattatgggatgtgttgtgggatttgtgtttcttttcataaccaaggagcagctgttttgtagttcaagggcagagcaatcaacgaaagtcatgccctgggctacccagaactcagagagtgcctagagaggtttttccttttgcaaaaggctgataatgtgttcctcagccttgcaggaaggtcacaggacaccaggcagtgcttctctgcctgtgaactcttcttattttgagtagagttgagatgtcctatagaataggagaaaacaggaaatgaggtgggattctcaaggtacaagcatgtatacatacctacacacacacacacacacacacacacacacacacaccacatgcacatacatgcacacacaccacatgcacacatacacacacaacacatgcacatacatgcacacacatgcacacacaccactcacacacataccacatgcacatacatgcacacacaccacatgcacacacacacacacaccacatgcacatacatgcacacacaccacacacactttgcaactacatataagctttagaaatgcctctcgcctccccccatagcggggaagagagtggtttaaactagaggagtctgaccaatgttcatttatctaccagtatacctcgcaaagagttttcagaaatgtgcatgagctgttaaaaacttctctctaatttccacatctgatctgtgtagtctgtgcagatctcagaatgtggatacagggttgtcttggggaagggaggaaggtctgaaggacctgcccatggtcagttctgcagagaactgtccctctccttcagtggagtattgggggttcaaccacaaggaaaggcccccgtaccctcaacctccctggtggggcctgcagctatggtagcttccttccttctgggtctgtctcacctctgaggcctaacagaaatgtcattaacactgaacacgttgctaccctttcctggttctgcagtctgtccgtcctccctcagagcctccctttgcctccatggtcttggtgctaagataaatttagaatcattgctgctagccaatagcttttcatgatataaatattatatatatatattatatattatttttgaaatgtttttgttttcaacagtgatgtagcatgttaaaacaagaaacaaaactgaacaaacgaaaatctgggtctttccaactgtcccactgccaggtctcttaatgctgccttcttcaacaagttgatacaccccacctggtgactttcacccctcatctcactctggtccccatcttaacccctcaccctctgagcagggagagttagcaggaactaggtaggaaaactcaaagccccttgcagaggcctgggaatcccccagcctcagcacccttgcccacgctgagtttgtgtctctcttcagctgcccctcctaccccggcccaagcctagctggagccacacgggcagctgttgcgaagcacaaggtctccacttgcctcgctcctgcctcaggaccccatctcctcacagacacagactttggtctgggacaattttattgaaaattgaataggccgaggtgggttcagagtagggatgggtggcaaggctggtctctcatgggcagcctgtaggcataaaccgtggcctgggcccttccttcttgccaacagttgccttacatctgtccttcccagtgcatggggctccctcacccaggaagggacctctcccagatggtcctaagccagacatgtaaaaccaggactgaccgtcccctcccaaggagctatagctgagtgaactcaggtcctcatccatagagacaggttctgccaggccaagccattgttacctgagtctcctcaagatacccaggatcagtggacctgtcttgaggcctagaagaatgagctgttctggcagtatcatgtggcttcagagtcacccatttccttggtcctctgtctcctcaaccccacctctgtcctctgctgcaatgacctctgcctcagagccactgagaagctgagctctacacgtgtcttctgctcagtctccgaaactctgggtgctggtgactgtgcagccaagcagggctgtgacagatgcaccatgggccactttgcctcgggatattgaatgactaagggacactgaggttgaaccccttgtagtcagcttggatgttccctgggagggtcagggcttctgcccagtgagttccatttgtgatgccctgtgatttcagacctgttcttatcctcctcttggagaagggcttgggtctgcccacccttcatgtctggcccgagaaccatatgcctggctcaccccatatcttggctgggttaacagactgtgggaaggtagggcttagagtgtatatgcagtcatttctgatgggacagggactgtaattcagtctctggagtagaactggtagtcacgggcatagaatgaaatgtatctgaggggctgagacttattctctctgggctggtagtggctttcattggttcacgttggtgagagtaagaagtgaggcagtgttgaagactgaggcttgtggccattgtgccaaatgggtaccttgctgaaacacagggttacagtgtgcccccccccccagcaaaggaaaacaatgaccactgagacaggtggaccactcagctgcgtgggcagctcctgcccagttagaatccctccagagacatcagagtgcgggcatcagaggtgccagagctattgttttataatgtctgcttgtggcatctccagctgccttaccccctcctcactggggaaggagagtgcactcagctccgggactctgtgtagttaagttctgcctggagccctgaatctgaggtcccagagcttctgccctctgctctggctgtgtgttcccagcctgcgttgttttgctgaggtttctgtttgacttgttcaagtcagatctttgattttgagcaaggaccttggagtgacttgaagcaccttttaaatgcctttcatttgtgtgaagggggaggggatgggggaaggtgtggagagggtgggtgtggccgaagagaggaagaaatggactttaagatgttacccagcctgagctggcggtcctttgctgcccccctggagccaggtgatgggggccaggagatgccggatgggttgaagtcttctagaacactcctttgttttttcatttctgcccccttggaaggcatcccaacctgttttcagtggatagtctgggttaaattctaacccggatttgtgcttttttttttctttttgtgatccatgcacctcatttggctgcaggccccaggttcactggagctcatgtgtgccctggatctcctctaagaagcagcccagccagactgggcatgcaacggaagcagggagaacagggcctctggagtgaggaaaggagggcagagccgacagttagggtgggatcacccctttacacactgccctggattccagcctgacggttcctcccttctttgagggggtggggaatgtgtgccgggtgtgcatggtcctcctactcggaggaatgctcttttctactcctctgttagtcagggtcactttaagagtctttgaggtaatctttgcatgttagtgagagggagaaaagtgctctctggagagaaaaatagtctggccctcctctcccatctagcactctctcccctccccccatcccttcaaatggtatcaccctagaaatacctatgcaatgcagtctccccaggaggctgtgcatggaggcaggggtatgtgcagtgtatcatactgatgctaaggcatatcaattgtatatacggacatatacagtacgtatacatgcagagtaagagagtaaatcacgtctatatatctataaataatatcctatatatttatacatttttatgttttaaatagatataaaaatagtctatagagctggaagggtggcggggaagcctggtgctgggttgggcttggggggaggagacagggctctggagaggaggtggggataatgcgcatcagaatgggttgctagccactgagatgggggcatctttcttggggtgttggagaggagggtggctgagcctgggctctctctccatgcactttctctcctttcctgccagcaaaggctgagattggaaggagatagccctgagctgcatgcaactgcagtaccctacctcccagcaccaccagcctgcacttagctgctcactgctgcttagcagtagggggttggacttggtccctgacccccagtgaagggacctcttgcacaaactccccaatacccgcccctatcaggagtgagcagcattgatggcaacgggaaaggggcacccgggacaaaccgtggtccagaacgatgtcagtcccatttcccaatgcctctgcctaccccctggaggccaagcctcccctgcctaccccctggaggccaagcctctgacacacagtcctggcctccttcacccatttaaccactgtctctagagcactgggagctggggagggcggcgtgcacttcaggtgcacttgatgcctttccccatccaaaggccccacctggtggaagagatatatctgcacactgacattttcaatggcaactcaaattcaggagcagggccttggcccacccgactctgcacagctgcagcagctgctggctgtactcaggacaatgttgtcccctcttcccaaaccaaccaagcagcccaaccacctccgctgtgtcagcaggtttaggtttagttcacaaacactgttctcattctgtgaccagatacccaaacccactctttctagggagggtatcttcttcagcttgtccccaggcaacacctcccccctcaagctgggtagggatgtctgtggtccctggaagtccagtcagcttgctcccagcatcctctattcccttctctctcctggaagttgacagggtctgatgacagatgccctccctgctctcgaggagcagcctgcctttgggctcctcagacacactcatttcccataccgagccttcgtaggtctctccctgcttctcctcaccatcctaccaacggacctcagtctccagcagaccagtcccataccacagttgagaccaggtctgctctgccaatgcccgtctccttgagccacagctagctgccaactgggctgaacacctcctagtgcctggctcagtagagttcaggaccaatggcccaagccttcctcccactacaatgggtcagagcttggccaggggataggcattcccagtagcaatcccacaatgcactgtacctcagagagagagagcatgccacagggcatctagtggaccagtctccatgcagaggaggcaacggctcacaatactgctcacgagaagacaaaggccaggctgtcctagggcatccctcagtctaccctttggcctctctggaagaaccagtaatctttttcagccctgatctctctcctcctctccacccccaagctgctgaaccatttttcatgtcaatcacaaagaaaaaaaaaagtgggggtggggggggactcctaggagcctattaccacatacatattaatatgttaatactttctttattaaaaacaattctcaatgttattatttggcagactgtgctttctagtacctgtgtgttggggctagaacactggatacaaatagagctatgctggtttataatctgtatgcagcgtctttccttttgtcacattatccttgtaatgtaagaagattattaataaaagcatttaaattgccaccccaagcttggctccttgcttctgtgacaggcctccataagtcgtgcataccctgtcaaagggctcaggtgtgggtttggaaggatcacaggtcctctttagctggtctctgccttctcccactatggcctcatttcccactgcagtccaattctggcaggaagcccctgagcatgtcaggtgggccaaagaagatatgactgaaaccgtgttaaacacctgcccccatgacactggccctgcaagaatcgctgtggggaagcatccagggcctctgcaaagccaatggctccagctctcttgcttacctgcatttggttgctctccatgagcgggcctgatccccacttagaaaagtcttagaactttgttgatagcactagggacagagggtgacaagcaagatcttttccacattttttaaggaaggtatttgacaggaatataggcagtattgtgaatgtagtcaaatacctctaagtgcaggtttatcctcttgagatgctgaggcctctgctctcagtccctatgcccctaacttcctcatagtggtcttccctcttcctgtctccttacttctgccttcttatcattagacatctgtcgttcagccaagaagcaccatcaccttgacagtggccaccaagcagctgttgtgtgatactatttatggagaagtgtgaacaaaagtcttctcaatccagatatagaaccaatagcagaccaaagtaagggtactatcaaagtccaacttggtgagccaatgagcttattggggctacttggagaaatatgagtgagagctttcttacaacaatatgggtaactcaaaggctgctacattaccaaaagcccattccaaggtgagtagtctcatgaaaaccagaaccctggccatctcttggtagcttgcatcaactcaacaagtaggacagcctactcttataatataacattggagagggaggagctttagaactctgattaagtttcagggacttcctgagacttatgagttgtttatttccagagtcttaagaagcctctctttagaacctctcaagtcctaatgagactctattcaggacgcattgtttcagttgctacacagtactctaccccttcctgccagctctttctgctctccttccattgt

SEQ ID NO: 1596 - DNA, 1367 bp, Mus musculus
tccccaggacagaatgactgagaacatgaaggagtgcttggcccacaccaaggcggctgtaggggacatggtgacagtagtgaagacagaggtctgctcaccactccgggaccaggagtatggccagccctgctctcggagactggagccatcttccatggaagttgaacccaagaaactgaagggaaagcgtgacctcattgtgaccaaaagcttccaacaagtggacttctggttctgtgagtcctgccaagagtacttcgtggatgaatgcccgaaccacggtccccccgtgtttgtgtctgacacgccagtgcctgtgggcatcccagatcgggcagccctcaccattcctcagggcatggaggtggtaaaggatgctggcggggagagcgacgtgcggtgtataaacgaggtcatccccaagggccacatctttggcccctatgaggggcagatctctacccaagacaagtcagctggcttcttctcatggctgattgtggacaagaacaaccgctacaagtccatagatgggtcggatgagaccaaggccaactggatgaggtacgtggtcatttcccgggaggagagggagcagaacctcctggcgttccagcacagcgagcgcatctacttccgggcatgccgagacatccggccaggagagcggctgcgggtctggtacagcgaggactacatgaagcgcctgcatagcatgtcccaggaaaccatccaccgcaacttagcccggggagagaagaggttgcagagagagaaggctgagcaagccctggaaaacccagaagacctaaggggtcccactcagttccctgtgttgaagcagggcagaagtccttacaagcgcagctttgatgagggagacatacaccctcaggcaaagaagaagaaaatagatctcatcttcaaggatgtgctagaggcctcactggagtctggtaacgtggaagcccgccagctggccctgagcacctccctggtcatccggaaagtccccaagtaccaggacgatgactatggtagagctgccctgacgcaaggcatctgcaggaccccgggggaaggggactggaaggtccctcaaagggtggccaaagagctgggcccactggaagatgaagaggaggagcctacatcattcaaggctgacagccctgcagaggcctctctggcatctgacccccatgagctgcctaccacctccttttgtcctaactgcattcgcctgaaaaagaaagtgcgggaattgcaggcggagctagacatgcttaagtctggaaagctgcctgagccctcccttctgccaccacaggtgcttgagctcccagagttctcagatcctgcag

SEQ ID NO: 1597 - DNA, 3504 bp, Mus musculus
atgactgagaacatgaaggagtgcttggcccacaccaaggcggctgtaggggacatggtgacagtagtgaagacagaggtctgctcaccactccgggaccaggagtatggccagccctgctctcggagactggagccatcttccatggaagttgaacccaagaaactgaagggaaagcgtgacctcattgtgaccaaaagcttccaacaagtggacttctggttctgtgagtcctgccaagagtacttcgtggatgaatgcccgaaccacggtccccccgtgtttgtgtctgacacgccagtgcctgtgggcatcccagatcgggcagccctcaccattcctcagggcatggaggtggtaaaggatgctggcggggagagcgacgtgcggtgtataaacgaggtcatccccaagggccacatctttggcccctatgaggggcagatctctacccaagacaagtcagctggcttcttctcatggctgattgtggacaagaacaaccgctacaagtccatagatgggtcggatgagaccaaggccaactggatgaggtacgtggtcatttcccgggaggagagggagcagaacctcctggcgttccagcacagcgagcgcatctacttccgggcatgccgagacatccggccaggagagcggctgcgggtctggtacagcgaggactacatgaagcgcctgcatagcatgtcccaggaaaccatccaccgcaacttagcccggggagagaagaggttgcagagagagaaggctgagcaagccctggaaaacccagaagacctaaggggtcccactcagttccctgtgttgaagcagggcagaagtccttacaagcgcagctttgatgagggagacatacaccctcaggcaaagaagaagaaaatagatctcatcttcaaggatgtgctagaggcctcactggagtctggtaacgtggaagcccgccagctggccctgagcacctccctggtcatccggaaagtccccaagtaccaggacgatgactatggtagagctgccctgacgcaaggcatctgcaggaccccgggggaaggggactggaaggtccctcaaagggtggccaaagagctgggcccactggaagatgaagaggaggagcctacatcattcaaggctgacagccctgcagaggcctctctggcatctgacccccatgagctgcctaccacctccttttgtcctaactgcattcgcctgaaaaagaaagtgcgggaattgcaggcggagctagacatgcttaagtctggaaagctgcctgagccctcccttctgccaccacaggtgcttgagctcccagagttctcagatcctgcaggtaagttcctcaggatgaggttgctgttaaagggaagagtggattctgcagatgaatctgtctccaacgacgtgatgacggcaaccgatgaaccctccaagatgtcctctgccacaggacgccgcatccggcgcttcaagcaggagtggctgaaaaagttctggttcctacggtactccccgaccctgaatgagatgtggtgtcacgtgtgccgccagtacacggttcagtcctcacgcacttccgctttcatcatcggctccaagcagtttaagatccacaccatcaagctgcacagccagagcaacctgcacaagaaatgcctgcagctgtacaaactgcgcatgcacccggagaagactgaggagatgtgccgcaacatgaccctgctcttcaacaccgcctaccacctggcgctggaggggaggccctacctcgacttccggcccctggcagagctgctgcggaagtgcgagctcaaggtggtggaccagtatatgaatgagggggactgccagatccttatccatcacatcgcccgggcactgagagaagacctggtggagcgcatccgtcagtcgccctgcctcagcatcatcctggatgggcagagtgacgaccttctggctgacacagtggccgtctatgtgcagtataccagcagtgatggacccccagccacagaattcctatccctgcaggagctaggcttctccagcacagaaagctatctccaagcactcgaccgggcctttgctgctctgggcatccgcttacaggacgagaagccaactgtgggcctgggagtggatggggccaacatcaccgccagcttgcgcgccagcatgttcatgaccatccgcaagacgcttccgtggctgctgtgcttgcccttcatggtgcaccggccccacctggagatcctggatgccatcagtgggaaagagctgccctgcctagaggagctggagaacaacttgaaacagctcctcagtttctaccgctactcaccacgcctcatgtgtgagctgcgctccacggcctccaccctgtgcgaggagaccgaattcctgggggacatccgtgccgtgaggtggatcattggtgagcagaatgtcttgaacgcccttatcaaggactacctggaagtggtggctcacctgaaggatgtcagcagccagacacagcgggctgacgcctcagccatagccctggccctgctgcagttcctcatggactaccaatccatgaagctcatctacttcctcctggacgtgatcgctgtgctgtcacgcctggcctacatcttccagggcgagtacctcctggtgtcacaggtggatgacaagatcgaggaggcaatccaggagatcagccggcttgcggactccccgggagagtacctgcaggaattcgaggagaatttccgagagagtttcaatgggatcgccgtgaagaacctcagggtggcagaagccaagttccagtccatcagagagaagatctgccagaagacacaggtcattctggctcagaggtttgactcccgaagccgggtctttgtgaaggcctgccaggtgttcgacttagcggcctggcccaggaacagcgaggagctcctgagctttggcaaggaggacatggttcagatcttcgaccacctggaagccattcctgccttctcccgggatgtgtgccgcgaagggacggacccccgggggagcctgctgatggagtggagagacctcaaggctgattactacaccaaaaatggcttcaaagacctcctcagccacatctgcaagtacaagcagaggtttccgctcttgaacaagatcattcaggtccttaaagttctccccacctccacagcctgctgcgagaaaggccggagcgccctccagcgggtccgcaaaaaccaccgctcccgcctgaccctggagcagctcagtgacctgttgacaattgctgtgaacggaccgcccatcgccaactttgatgccaagcgagccctggacagctggtttgaggagaagtctggcaatagctacacactgtcagccgaggtcctcagtaggatgtctgccttggagcagaagcccatgctgcatgtggtggaccatggctctgagttctacccagacatgtag

SEQ ID NO: 1598 - DNA, 63720 bp, Homo sapiens
aaccctgttgcagacaggcccaggcaataaagcagtgtaagaggaagtgcagaggtagcgtggatttcaggacctgttggttcagcacctcaaccgtgtcagttacagtttctgtctctgagatggttcccaacaccagccccttcttggattctccaacccaactgggtgtccaacaattcaattcaattcaattctgtaactatctagagctggtgcagaccccacaagataagagctcagttacacaagactgccctcaattcagacactggtcataagtcccaggggacttgtacctctgaccaacataaatccagggctcctacaaacccctttctcaggtgtgataattcacttgaataactcacaaagctcaggaaagtgatttacttactattactggtttacataaaggctacaactcaggaacggccagatggaagagctgtgcagggcaaggtgtagaggaagggacctggagcttccatgttctcgctggaccctccacccttccagcaccttgctgtgttcactaatccagaagttttctaaatctccttcaagagtcttcacagagcttcatctccagcccctcttcttgttgccagaggccagtggttgggattgaaagttccaaccttccaatcacgtgttctttctggtgactcagcctcatcctgaagctatctggggggtcccaccctcagtcatctcattagcataaactcaggtatgatccggtggggctccttatgaagcaccaaagacactcctataacccaggaaattccaaggttttaggagctctgttttattagccaggaaccagggacaaagaccaaatacagtcaacccctcctatccatgggcatccatggattcaaccagccatggctcaacagactttctccttgtgattattccctaaacgatacagtatagcagtgatttacatagcattaacattgtataaggcattataagtaatctagagatgatttaaagtatatgggaggatatccaaaggttatgtgcatatactatgctattttatatccaggacttgagcatccttggactttggtatcagagagggtcctggaaccaattcccctcagataccagggtgcaaatgaatgtgtgtttcttgtcctaccaccctgtccccctgctctgaggaactcgcttcatgctgaagatgcttcctgctggggtcctctgcaggacatggctcccatttgcaacaatggctgtgtgctttctccttctagtcatgaaataaaagcccttcccttccctttgatttggtcaaaataagtcaaatgtctgatcttggagggaaatgtcatgtgctgattaaaggccaggttcctgatccagtcattggggagggaggtggcattgctagaattggcttagatgaacctgagcccagccctggtgctgggcaaaggctcggtgtctctgaatctcacttagttggtcctataagggaggtgtggcacctgaacaaagtccaacttccagtggggagtaatgaggtaacggataccatagaagccaccagcaggatccactgtgagaagcaaacacataaaaaagttctggctgggcgcggtagctcacgcctgtaatcccagcactttaggaggctgaggcaggtgaatcacctgaggtcaggagttcaagaccaacctggtcaacatgatgaaaccctgtctctactaaaaatccaaaaattagctgggcgtggtggcgcacggctgtaatcccagctactcgggaggctgaggcaggagaatcgcttgaacccgggaggcggaggttgcagtgagccgagatcacgccactgcattccagcctggacaacaagagagaaacaccgcgtcaaaaaaaaaaaaaaaaaaaagttctgcgggagggaccgccttgggagaatgtgttccaccagccctggccagctatacccatgatgcttagtggcgactgccctgtgggtaaaagctcaaaacctcattttccatgaccccagcaggagcctccactggctggaccccagttcctgcggctgcaaaatcagggactggacagggttagaggtccccatatgggagttccttgccctcaggaggctccagcagatggtttttctttatgtttattaacatatatatattcagaaaagtgcacatattgtaaaagctggctgagtatatttccacaaacttattatacccatgggatgagcacccagatgaagaaatagaacatggccagaatcttagaactccttttcctgcctttttccagttattcccaagaataaccacaaacttcacctctaacaccatagttgtggctggttggttttttttggtaactctatttaaatggaatcatacagtatgagtctgtactctttgggggtctcctttcttttcttggcattatcactcatccagattatagcatgtagttgtagtttgtctattctcatttctgcatagtattctatccactgaatttggtgaatattgtacagtatcctatgatcaggtaggacaagtgaacaaacatgtcaaatttctttgcttttgcttaggatgacggccgctaaccagtgtattaactctgcttatcatgcaccctgtgtgtatacaaagaactaggaagatgaattaattattacctaatgcatgcagtctttttagtagacatgatcttccaaaatgggaatcctaaacaaaaataaaaacaggtatgcttcgggtagagatatgggggtccttaccgattgattgattcattgagtcattgattcattcgttcatcaaatatgcatcaagcgccacttgtgtgcctgatactcagtctctaatctggattcctcctttctcctaaccaattggcaggatctcagcatctaatgacaagtgggtaaaggtcattggaattatcttctttagcaatttctaaactaaatgattatgaagaggtcctctaaagaatatttaagtgactatttttcagaagcaaaaagaagaaaacagaaatacacaaccctcctcctgaactaaccactagtgataccttaaaatatatcctcccagacccatgtgtacagatctgcatcattatgtatagactttaagtggaattattttgtacacctgtgtagtgtgggaaattaaaagtgttttaatggaattattttgtatctatcttttcatagctttcattaacaaaatccttgttttttagagcagttttaggttcacagcaaaactgagcagaaactagagttccccatacaccctgcccccacacacatccagcttcccggttattaacatcccacaccaaagtggaacatttgttacaattgatcaacctccattgaaacatcgttatcaaccaaagtccatagtttacattagggttcactcatggtgttgtaccttctgtgggttttgaccaatgtacaatgacatgtgccttccattgtagtatcatacagagtaattttactgcctaaaaatcctctatattccacctatttgttcctctctccccgcaacccctgccaacctctgatctttttacagccttcgtgattttgccttttccagaatgtcatatagttggaatcatacagtatgtacccttttcaggttggcatctttcacataataacttgcattatcatttagcaatatgttgaacgtgtgttttcatgtcaataaatattcctctacagcattgttaattgctgtctattatttcattgtatgctaatatttcattgtgatatagcatagcaatttcccccattttggaggtttaaattctttcctattttttgcttttaaaaataatattgcagaggacagctttgtaggtaaatctttgcacgcaatttaaatacatccttaggatccattcctggatgtgggcttgctcctacaaagggtttacttactttgaggattttgatacatgtgccaaattaccctccagaaaggttacaccaatttacactccaaccagtgggatatgaagtactaatttcccctacactcttgccaactctgaataacatcaagatttttcatctttgccaatttattagaggagaaatgatatttatttgttttaatttgtatttatttgagtattaatgtcttcatggttttccttaaagcatattagccatctattggtctttgcagattgcttgttcatgttttctttttatccatttttttttctattgaggtaagcatcttcagagcatatatttataaaaagtatttattaggggtattcactgcttgtaaaggccctcttctaatgtcaaacaatttttggccgggtgtggtagctcatgcctgtaatcccagcacggatcccagggcagatcacctgaggtcaggagttcgagaccagtgtggccaacatggtgaaaccctgtctctactaaaaaaatacaaaaaattaggcaggtgtggtggcaggtacctgtaatcccagttattggggaggctgagacaggagaatcgcttgaacccaggaggcagaagttgcaatgagccgagatcgtgccattgtactccagcctgatcgacagagcgagactcaatctaaaaaaacagaaatttcaccaccatgtgcacatctgatgtctgttatacttttaaatattaataaaatgaatgataatatttatagggtacttacgataggtcaggcattatgctgtgttaaacagccctatgagataggttctgatatcagtgccacaggacggatggggaaaccaggtaggcgtggttaatgcagtttctcaaggttacacagtttgtgagtggctgtgctggtgttaattgattaacaaaatacatggtgacataaggtttctatgaattcaataacacttttaaatacatttatcttttgtgttcatcacaaaagtattcatttgcaaatctgtcttatacatgtaagtttaaggcatatatttatgttctctataggcatgcttgctgagaatataaattcaataactccctataataattccaagcccttgcccacctctcacatggtatactgttaaggactatgagttggaccttttattttacaggaaagagaaactgagggcaaggcagaaactttatcagggtcacctaaaaaactgacagcacagccagaactgagacccagggcttgggattcccagcccaagtcaaggtcagcatgtggcttgggccagcaccctaacctcatgtccttttggtatcaatgggaacaacagagatgctgtggtaggtaccagagtaaaccttctagattctcatggtgccagcctctagggaaaccaagtgggcacagatccccagtcccctggctacactggctcctgggcattccaggatcctggcaccctgccaagggtgaaaacagagctgcagactcctgggctgcattctgcccccttcttttgggtttgcagctcactgctgggtttgcaacaagcctaatctctgcatgtgcagacttagaggagccagctgagagggagcattgccagcagcttggaatcctccatgaagcctgccgaccccccttcccccaagacttttgctgggcaggtaggactagagcattcttcagaaaaggcaacaggggctttacctgggccaggccttagagtgtctgctgagatggactcagtgaaggacaccagcacatgttctccctctctctctccccagtggaagttcatttggtcctgccacatcccatcttctccctccctgtccctatggcctttatcacaagcacaaaagtctgtctatttcaaagtagagatgtctatgggccacttgagagttggaatgcacattagtcctttgaggcttgatcctggttctccgggcagccagctccaagagtagaaagaaattatatgtgcatatagtcaataaataggtgtcagataataaggactcggtaactcattatgtttccctttatgctttggctgccaggaggctcagaattgaatgaagaactcaatcactaacccttttacaacagattcccggcataaccaacacccctctttctccatgaggcctctaacactatctctggttgtttcttaactgtcctgtttagtatgtgtttgttttataaaacattgcaaatcttttgtgtggtgaaggtgggatgtgagagataggacataaatgcaaatggcccacagatgtctctactttgagatacaaagtaatactttgcccacagggggtggtttgctgggaatgatttaagacaggaaaacgtttatatgcctcggtccttctctttcaatctcccttcccctcctcatcttctcttttctcccttctctcctccttctctccctgtcttaccctccgtcctttattctcttactattgcctatcctccctccaaaccccttccgcatccctctgtgccctcctcgtttattcctaatggggaccacctcctcctggcaagtatcagtatttccattttgcaaaagaagacactaaggccctagaaagtgtaagtgacgtgccatggccacactgattatcctccccaacttatcgtcagaatccggctctgagtctcatgagtctaattccatcctaccccctagtgctccatcctaccccccagtgcacctctgcacccttcagtgcccaccctgccagcatctctcactacctgctctgcctggcggagatcactggaagagagctccatagggaatcaaacccccaccctgtttttcctgctgacgtctctttcagagttgagattcccaatgggaccagtgggacacatcagagggaccagtgagatatgaaggggaacatttggtgaatatttactgagaatatgctgtgtgctgggcaaagtggagagtcagccaagcaaggttctcagggtgcaaaattgaaagaggttctcactctcaggtgccagtcctgcaagcgtatgaccctcagagtgaaagcctcctagtacctggcttgtctttccctagtcttggccctggtgccaggcactgttacaggtgctggcagttcaatggtggcctgcaccctgtcctcggggagcttacagtctattaagggaaacagatattaatcaagtaatcctgctaacaaaagacggttatacatgtcacactgccatgaagtgtgacatggggctaggagagggtgtttttggtggcagttggaggggggcagtgaggtctgaagtctggataggagttccccaggtgttctgcaggctaggactcagcaagttcacaggccccatggcaggatggagaatggcatacaggtggggcttgtggagggcagaggggccagagcaagggagccccatgcaaagcagtcctcagcagtccgttccaataaagcgtcagagtttccaaatgactgacttaaaaaaaataaatcccagccaatggagagaatttgaagccaccccttgatgatgtcactagcactcatcttcctgatcagcattctttagtgggatgtgcagagactggcccctccacactcgtctgtgtccacggaatacagctatgtctgtgatagaatctattattagccacattttctagatgaagaaatgagaacacagagaagttagataacctgctgtattagtcatctcaggctgccatgacaaaataccgtagatgggggtgcttaaacaacagccatttatttctcacggttttagagcctaggaagtccaagatcagaatgccagcctattggttcctggtggtggcactccgccttgtggatggctgccttctggatgtgtcctcatggtggagagggccctggtgtgtcttcctctccttataagggcacctaacccttatgacctcaattaatcttgatcacctcctcacagccccatctgcaaatacagatactctggggctgagggcttcaacatatgaaggggagtggggtccataacacctgcccaggatcacaccgcccatcagtgggatttgaactcaggcactgcctgtccagtgcccaggcacctaaccactgaggctccgccccaggatgtatggtggggggtactgcccatcccagtgagagttcctcagggcagcaggtgttcagggatccttcacaaatccacagggccttgctcccacctggcagctggacttctgagctgggacctgaacccacttaagggtgatcccagcgattgttcggtagaggactggactgaggatactgcatggtgaagccaacttgaaacacttgaatctgggggttcagccagtttccaatttactaagcagccatcgggtgtggtctgcatgaccttcggcaagtcgcttgacatcttccaggccccaattcctgcgccctcacaggaggcagggggccatcccacaggctttgaggtcggtcgagcacccagcggggagtccctggcataacgcagccaggaggcagtagagtggcaggcgccccaggcggtgcaggtgcggccgcggctgagcgagcgggtgtccggtgtccgcacgggtggcagcgcaggccctgtcgtcgccgccacaccaaggcagctcggaggctggggacacccgcccggcctccgcggcgctgtcgcccagccctggcaccccccgggccgagtgcgcatcgggccccgtgggaggccctggaatgcgtccaccgcctgacccggagcgaccccccgcggcgccctctcccaccgccccgcccgggcgcccgcttcctcccgctccctgcgcgcccccctcccggccgccagccaactgcgtgcccccagggccggcaagaagccacatgcccccgcaaggaatgccgggcctggcgggcggggggcgggcgctgggcagggccgggcgggccgggccgggcagggagctccccgccgggaaggctggcgagagggggagagcccgcccgcgcccgccccggccgcagcctacaccggcccgagacggggcggccacggggcagggggcggcgcgcccggcctgggcagccctccccttccccaccgcgcgcccccggccctgctggctcggaggagggggcaggccgtcacgtttccccgcacccctcccagtcgccgccgccggctttggggccccggtggggagcagggggctgattagccgaggagcaggggtgtggccagcggggccccgggtagtgagtcacacacgccgctcgcccagtcccagggcccagcgccgtcccagccccaggctgcgtgccaccctcgccccgaagagtgtccccgggcttggcatgaggaccccggggtgccgagggaggggctgaagcccggcgcggtggtggagggcggtaagcggcgggctggggagtgtccccttgagagagtcgggtggggctggagccctggctggccctcgccagcgcccccaggccctgcctgtacctgctctgagctggcaaaggggcctggctgcgctcccggcagtcccagggtgaggggctgccctgccaggcgctgagggcccgttcggtctgcccactaccccttggcccaagttgggcttgagttgtgaaccctcccttctcgccctttgcagttttgcgcccaggctcatgtgggatcctcctgccctttgccctttggtctaggggtccaggctatgcttcccagcgcggcctcctggcctgagctgctctaggctcctgaccccatggggctggtggctccagtcgtccccaggaccagcccgggatagaaacggcatttcctcttggccgggctacagctgtttttgttgtctgtgttctcaagtgcttcctctggggatggcagggagggtaaccagactccgcgagacccccacttgccctctccgccgctcactcctcttcccctgtttctttgatcctcttcctgtgctggtcccacctcctgcgtcccaggacagaatgaccgagaacatgaaggagtgcttggcccagaccaatgcagccgtgggggatatggtgacggtggtgaagacggaggtctgctcaccactccgagaccaggagtatggccagccctggtgaggcccctgtgtgggaactggagagggagaagtgggagtgggaggtgcctgggctcggttggttgggaaccctgggaaacgttctcactccttgcccaccttccctaaccctgctcccggcagctcctgggcgcaggctctagaaaaatccaagcagtggcctagggaggtctgtgctcgcatctcaatcctccagtttttccaccacctcctgcactgaacagcaggctggctgggactcctctgcccaccccacatcttctcggtctcctggccaggtccccagcttttgtccccactgggctctcactctctgatgacttctttgctttctttgcgggcctctgccctggccagctctaggagaccggactcctcggccatggaagttgagcccaagaaactgaaggggaagcgcgacctcatcgtgcccaaaagcttccagcaagtggacttctggtgtaagtggagcttggggctctgggctgctcctcccttcacccccatcgccccattcctggctagggaattcacaacaatgctactaagataggtcctcacctgcaatataccaggcccaggtccaggccttggttcgtcatcatcattagccatccaaatggctattgttggccccattttccagatagcacactgagtcttggtgagggttaagtatcccacgcctcgagtcctctggcccaaaggggtacagttgcacttggactccaaagccatgctctttcttccagttttttaaaacttgagacaaaggtagctgctggcctccttgacgtaggcaggcctgttcttggagcccccagggagagtatgggttattgctaccgatgaccctggggcctgcagctggctgtccatgagtgggcctcctgtcagcccctctacctcccccatgggggtcttacctccctgcaacaactgaggccctcccttctctttccatccctccagtctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctggtgagtgtgccctgggctattcatgggagaggttgccaagaaacatggaaggaaaccaccagggggagccatactggcccagcttggccccagaacttttctaccatcgcttctggacctgtcgatgatggatcttgctgtcccctggccccggctgagtggctgcaacgcttggtgtccaagggcaatgctgagagcacccacctggcagtagtcagcagatcaggaaatcaccaagcagaactcagggcaatttccccatgaatcctcatgtgtgtgtctggtggaccattgggcagtattgaaccaaccgatcttctagagtgggtgactcggagctggcctttggggatgcagagcatgacttcccacttccaaaccagtaatatcaggctctgggctaggtgctgggggtaaacccttcaacaagacagacatggttcctgccctcagggagcagacgatctggtaggaagacaggcattgaacaagcaggtacacatgtgatatcagttgcaacacagggtactatcaatagatgggttgcaaagatgaggaagaggggttttcaagggtatgaggaggaagggttaccaaagcaactttaaggaatcatgcttgagctactagacagagataggggagggtggggtaatagagaaaagcattctagagggtaagaagatccttattcactacaaaaacacttcttgagtatctcctttgtgccaggcactgggctggccctggaaatacagtggtgggccagataaggcaatcagataaatcctgccttcatggagttctctgtgggaaagatagaattaatcaaagactaagacaaatccatgtcaaataataactctgagggtgatggagaaacagtgagactgggaaaaagtgaacaaccaggggaggtaatatgggtagaggtcagagaagccttcctgctagttgagctgtgattgaaggaggtgaatgcctaccaggtgaagattggagaggtgcatccagatgccttggacagcaagagcaaaggccctgtggcaggagagcatggtacatctgagctactggatgaaggtcagtgtgcctggagtgcagcacacacaggggcctggagatgatggaggcttgattttgtagggcccagtggaccaaattaggacttctgtccttttaataatgtaggagttgggggagtgacttggtcacatttatgttttgaaaagatgactttggctacagcctggagaactgattgagctcaggggtgctggtcaagaatgggtacccacacccctttccccaggtagagcgtgtgggagttctgtagtcggcaatggtggaagactgggctagggttggggcaaagacttggagccaaacgaactgctttgtgaactgtatcagagaggagagctctgacttagacatagactaactggcctaaggaagggagcaggaggtatcaaggacatctgcagtctcccaacaggttgttaatggtgtctttctctgagaaatggaggaggctggaaggggactgggttgagggaaaaatcatgatttgggtttgggacttgttgagtttggagtaacaacaagatatccaagtggtgatgtcaagtaggcagttggatatatgggtccgaagcttggagaggaggcttggagatgttgcttagtgagtcacctgtgcatgggtggtcagtgggggtgtgggtgtggagcgcagaacctagggagaatgtgctgagtgaaaggtggaaaggcctgtgagcaagctttgagggactttagcagttcatggtctagaaggggagcttgatcctgcaaaggagacagagaaggtttgcagccagagaggtaggagggaaaccaggagagtgggtgacctggaagtcaggggagaagagaggttctccaggccacaatggctgtcagtgccaagtgctgctgagaaaccagccagaaagactgaaaagtgtcccgtggatttactaccagggaagccatgggtgactttagcaagagctattgtagaaagcagtgggtctgaacctgaggcaattttgcagcccagcctcctgtccccggacattgggcaatgtctggagaccttttggttgtcacagctcagcataggggtaagctgctggcatctagcagttggagaccaggattactgtaaacattttacaatggacagaatagtccctcataacaaagagttatctgcagaaaccctgctggagagtgatgggggtggaacctgattagcatggaggtgaccaggcatagtcatttcctagaagtttggttacagataagatcagaagtggaggagaaagataagagtgaggtgggagggtgtgtggtcaagagagtttgttcattagaaagactttagcatcctcaaaaagccaagggaggggttctgctgaagtgcttgagtgtagagtagagataaggcatgattcctaaccttttacatcacctcagagggttcacatggagatactggacaaaaaagggggtggatcagcatcatttctgtccctacagggttagcccagaggattagagcagatagagatagttaggtatagtaggccacataatgtccccccaaaaatgtccctgtcctaatccctagaacttgtaaatatactatcttcatggcagaagggattttttgcacatgtgattaagttaaggatcttgagatgggagcgatgatcttggattacctgggtgggcccagtgtaatcacaggcatcttaataagagggaggtgggaggctcagagtcagagagaaagggattggaggatgctgctctgctggccttcgagatagagtaaggagccgggagtcaagggatgcaggcagcttctggaagccagaaaagtcaaagaaacacattaattcccagagcttcctgaaagaatgtggccctgccaacaccttgattgtaggacttctgacctctagaactataaggtaatacatgtgtgttgttttaagccactgtggttttggcagtttattggcaatttattacaggagcaacagggaactcatataggaggcttttatgtttgtggggggacatctactaaaatatgcagggaggtggattgaggtggcctgaaatcgaggagatcagagaaggtgagttctgcttgggatgagtagagttcctggtgcccgtgagatgctcaggggagctgtccagagcactctggtgtgtgtggctctgcagtagagagatgctgggatgacagggaaaactaagtatataaattaatgcagctgaagcccggagaagggagggcatttcctacagaaaaggtgcttggggaggagagaagaggcatttcctttggaatatgagtttgaggaatccttggagggagaggagttgaggaggcatggagcagtaggaggagacagtaggaagtctccttggcccccttggcaggagcagtctcatgggcggaagccagattgccatggattaaggtgtcagtgggaggtgaggaaagggaactagcaagggtgcatggcttgttttaaaagtctggttgcccactgagcaattattatatgccaggtgcatactggacacctctggcatctcatactcttcctcgaaacagtccatagggtgggggttgctgcccctcttgttctgacgaggaaacacaggactcccacagctggtccacagtagaccttgggttccttcaaagatagtgtccctccaccatgtgaggacttcccttattgggagacattgctaatggggtggagcagttaatagctaccctgagccagttttggttatgtgtccaggttcaacccaacctcacatacacagagcaactccagagcactaggtcctgagcagggagctctggggataacagggctgcgtgaggtttgctgtctgttcttatggagcctgtggttcagttatgaggagcaggggccatggtggataggaggggaggaagcttattcccaaccaagtaatacagaggcagagtattgcttggtgatcgcagtgctgcagagggctgtagcagtagggagagggggattggtttcaacagggcagattggagatggatcttgtcttgaaggatggatagacgttcaacagaggaagcctatggcttcacagcctattggaaaattgcaggagaaaaaatctaggactgtgcccaaggaatggctattaggatccctttctgcagctgctagagtctgtaccttgggacagcccagccatggaaagttgagaatctttaaagcagatgaactttcccaggttggctgcctggcacaggtctacggtgagaagaaaggaggaatagaaggccctggtgtttgcaacctggttctagactagctccaccagtcacgagtaggcgtggccccagttcaggaggtgggactggtggcctggaggttattccctctgaggtttcttcctagggccttagctgcagccagcagccagcagccagcagccagcagatgggcacagggaggcagtggttagaggctgcaaggccatatgggggctttgacctttgggaacccaagaggtgagagacattgaaggcctagagccaccagatgcttaaagtggctcaagaaaagttcgtgtgtgtgtgtgtgtgtgtgtgtgtgtgtgtatgtgtgtgttgggcatgggtttttggcctccactggggaaaagcaggcgtgaagaacggctctgcctgctctgctgatgggtaggccaaatggtgggagagtacggggaaggtggggtgaacagtggtgctgatttttggaccaagatctagaagccccatatcctaaataaactgccctcatttgtcaagtcctgtcccaaagccatactggatatcatcttctttggaccttctgcctgcctgcaaaagctctggcccccattcagcacaacacatttccctccacactccctccctcagtatatgcactctactctgtagaaatgatggtggtggtcatgacaagcatagctgttaatgtttattgagcacttactatgtgtctgggtctgtgctcagtgctttatagcataatctcatctgatcctaacaacgctcctgtgacataggtattattccatccattgcacagctgagaaaactgaggcctggagaggatgagtcattctgcacaaagctaaacagctggtgagtcactgagctggggttcaaacctgtgcagtctgactccagaacctaccctctcattccgcctcttggccctctagcctcccttacttagcacgcctcttcttacctccttgcctgggtagactctattctactcattcttcctgcccagcacaagttccctctttgtcttcgcttaacctggaggaaagctggcctgactttgggcagagtggtacaaggcatgggcctgggtcataatggaccgaatggccatttccactccacaactctccttcgtggcctggctgacttggcaggagttggacactcacctctgcctgtctaggaaagacatgccccttgctctgctttttcatcctattggaaattataaatgctgtgattcattgccaagatcacccaggctaccctcagacactgcaggccaggaaccatgctgctggcacgaggcatttgggggtgctgcgcagccatgtggtttggtaaagaggcagaagacagaggaagccaacatgggattttttgtttgtttgtttttttgtttgtttgagatggagttttgctctcgttacccaggctggagtgcagtggtacgatctcagctcaccgcaacctctgcctcctgggttcaagcaattctcctgcctcagcctccctagtagctgggattacaggcatgcgccaccacatccagctaattttgtatttttagtagagacggggtttctccatgttggccaggctggtcttgaactcccgacctcaagtgatccgcccacctcagcctcccaaagtgctgggattacaggcttgagccaccacacccggccgcgagcacagggtttctatgtaagtttttcgttcagaccttggcttgttccagaagggatttagggtagcctagcagtatacataaaatataccacaatggcatattaaaactgggagagagaaagaagaaaggaaaacaagggtggagaccctaagtgaagccaggaatgaagctaaaaatgcatactataatgacctctatctgcacttttagctatacaggctccaaatctggcagccactgggagagtagctggtacattctgtccataatgtgaaaaggaccagggagctcctgaggaggtccgcccttctgggcgctgatactggataggtttcccaggggcccttataaagaggacactgtgtggtggaattgtccactccatgcgaggcagcctccccacctgccagactgctaccgttctggggagaagcagatatgaaatggtgttttagtgtttcccatttcagcttttatagtaaattgacaatttcttttaaaacttgaaagtggacgtgccagagctcatggcacatcctccagaaaagcctctgagagaccctgagtgcttagctagatgaaataagcagacagttgcagtgccatgacatgtggtggggacaggcaggtgttaccaagttcggggatgctcagagaagtgaggagtaacaggtttgttcgagaagaaagaaaaggggcgtttgagacagggtagtcgtgcagtgtgtgagcatgcacgagcaggtgcttttcatgcttgcttgttaatttctactctttattttgaaagttgcaaactcggttgaaaagttgcaagaatagtgtaatgaataccctcacacctgcctgtagattcatctattgctaacactttatacccattgctttatctcactttctacacttacaccacctacacacacacgtgcacacacacacacactttttttttttttcttgagatggagtctcactctatcacccaggctggagtgcagtggcatgatctcagctcactgcaacctccacctcacaggttcaagcaattttaccaccccagcctcccaagtagctgggactacaggcgcacaccaccatgtctggttaatttttttgtattttagtagagatggggttttactgtgttacccaggctggtcgcaaactcctgagctcaggcaatctgcccgcctcggcttcccaaagtgctgggattacaggcatgagccaccgcgcccggccatacattctttttttttttttttctgaactgtttgagatatagttacagagacatcatgacactttacctcaaaacacttcagccaaattcctaagagcaaggtgttcttctataccagggtgagcaaacttttttttttttaaaggctacctggtaaatactttcggctttatggactgtgcagcctctgtcataactactccactctgcctttgcactgcaaaagcagtcatagatgatacatgaatgaatgagtgttgctatgtttcaataaaactttatatgaacactgaaatttgaattgcatattatttcaaatgaaatttgaaagtcatagaaataaaattacataaaaataattttttagtcattaaaaaaatgcaacatgattcttagcttgcaggctgtataaaaacagacaatgggggctggatttgacctacagccatagttggctgacccctgagctatttaaccaccatataatgattacacccaggaaatttgacatggatacaatactgtctcagctatagttcgtattcagatttccctaattgccattagtaacatcctttgtggttttttccccatccaggacccgtgcaggtatcacacattgcatttagttgtcacatctcattagtctcctttattctagaaaagtctcccctgtattgttttttttcttcatgatattgatacttttgaaaagttcaggctagttgtttgcataatgttccacagtttagatttgtctgattgtttcttcatggtggattccgattacagctttttggcacaagcaatgttaggtctttctcacggtgtgccatcaggaggcacctggtggcagtttgtcttgtcttttactcaatggttttaacaactattgatgattcttgtctgtatcaattattattcatggttaaaatgatttttctattttttctcttctacatttattatttgacattcttctgtttaaaaaagatagtgctcaaccttcacccccactcaatcctcatttaaagctatttttagtattcatatgaacatgaattctttttttattcaatgtgttggaatccatgtctgtcattattcattttgatgtttaaattgccctagatttggccagtgggaacgctttcaaactggctccttgttcttttgacacatccccatcattattttagcactttttccttactttctggcacaaaaagatattcccactgtctctcgtaggagctgtgattcctttcagtgggaaatggtgtttaggagccaaaatctctgaatggtaggtgtgcaattgctactggggtgtccttgcttctaagccaaactaggttttattattattattattattattactattattattattttattttactttgagttctgggatacatgtgcagaacctgcaggtttattacattggtatacatgtgccatggtggtttgctgtacctaacaacccgtcatctaggttttaagcctcccatacattaggtatttgtcttaatgctctccctcccctcacctcccacccccgcaacaggccgccgtgtgtgactttcccctccctgtgtccatgtgttctcattagccaaactaggttttgagggagggatggatgagttgatgcaaatgtcctaccatgtcagaaactgagggaacgcagcatagcagtggtcatggaatttacaaaggccctggggcacacacgtaacagtcaggtggggatggtattaatattagggtataacagaggtaccaagtgtgtttagaaggaaaagtggaagatgagactagagtgaaagtcacttttcttgtgttctcagatgcaatggatcataaaacactgttgattcaatatcagcttttccaggagtaaaaatgaatacctcaatccaaagattctgaatatcagaagcattaaatgggctcagcttgtgtagctgttttataagtgctggtagtttagttattgaatcacaaaccaaaccaaagatttccccaggaaaatgtaatatgctcatgaaccagttctggctggagccaagtctgtacatctattgtatcagagcaaaagtagaacatgaaaaattattctgaacctgtataatatttccagtacagaccagctcctaacctgacctcctctatttcttggctttccagtccattctactgtagctgtgtttctcacacctgaacagtgttaagttcaggtgatttttaatgttcctggagtcttcatgttacattaattttattttcatgttacttaaaaaggtataaacatatagcttggtaaacacaaagtgtcttgtacttataacttttaaacaactgtaaagccaaaacaagtttacacatataaaattaactacaaaaacctcaacataatacacattaacaaagtcattctaatgggatagttgatgatgtgtcactgaaacaaaattgctatttataaggcgaatatcgtagtgactactgagacacagcaagagtctttggagtttggaatgcctgtacttttgtgttcagtgtgatatctttactttcctactatttgtctctatttgaaacactgggaaatcttttatttatgtatgtatttatttatttagaaatgggaacttactctattgcccaggctgagtgcaatggcaagatcatagctcactataacctcaaactcctggacttaagccatcctcctgcctcagcctccagagtagctgcgatcacaggagtgtgccatcacacccatctatctttgttattgcaactgccatgatgtgtcttggcctttgctttgccggagtgcaacatttacatattaagtttatatctgttctttttttgttggctcatagcaagtagtcataattggggttgtatggtcaactgttggggtaaaacaagctacctaaaaacccagtggcatagaacaagggtcagcaagtgttctctgtaaagggctagatagtgaatattttaggttttgcacactatacagtgtctgtctcaatgactcaattctgccatcatggtgcaaaagcagccatcagtgtgccatgttccaataaaagtttatttatatatagtgaagtttgaattccatataattttcacatcatgaaatattgtttttctcttgatttattttcaacaatttaaaaatcattcttagcctggtgggccatgcagaaacaggtggtgggctggaattagcccacaagccgtagtttgctgagccctgacatagaacgacaatcatttactcttgctcacgtatctgctggtcagctgccgttcctcatttctacttgtgtatctgctggttggctgcagtttggctgacatagctgggcttgctgggctgcccggactccagctgctgggggttcttggcttctctctctggagccaggtctgctccagacacttggagcatgtctgttctgggccccagctgaaggagcaagggctccctgggggagcttttctacattttgaggctttgctcatatcatgtttgctaatatctcattggctacatcaatttcacagttgaacgtaaggtcaaggagcaaagaagtgcaggctgcctgttaaacagtctagttcagaatcctgtggcaaaaggtggtacggatggctgaagagctggggccagggattcaatctgacacggatgccacctcagccataaattcagtactcttgcgggtgcagaaatctcatgaggattcccgcatattgatttttttaaatgaaaacatggaattaaaaattcttagagaaaacattcagatcctgagaatatatccaaagaccctagtttgagagacactaatttttagtaaacttcctggctttgccgcagaagatttggggtttcttggtgtttgaaaattccccaaggagagctcttgttgaactaggctctctgaacctaattcagcactccaaaccccagtgggtcctccaaagatgctagttagggttgatgaacaacaataacaacaataatagtagtaacaataatagctgctgttcactgagtactaaatgatttgtatatctcacaacagtactgtgggatagttattatcttctttttttttttttttttttttttttgagacggagtctcgctgtgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccagttattatcttctttttaaagattgggaaactggggcttaaaaggccatgttacttatctaaggttatacaggtcatttatggggccaggacttttaactagatctccagttcatcatctccaggcctcagatgtgaatatctagaatgccttcctggcatcccattgctggtcttcccacttgcatggaaacctgtttctttagggggtcactgttcaagcataggatatgtaggacgtaagatcgttcccttctccttgtttgattggtaacaatgaacctttggcagattttattttttaacagctttattgagatgtaattcacatactatataattcacccatttaaaatgtatgattcaatgattttgactatattcacaggtatgtgcaaccatcatcacagtcggtttcatcaaatcctgtatcctctggctgtcgttcccctcttccaatccccttaacccacatcttcaacccctcacccccacccatccctaggcaaccactaatctactttctgaccctatggatttttctattctggcctttcatataaatgagattatgtagtatgtggtctttgtgacaagcttctttcacttcgcttcatgttttcaaggttcatctgtgtggcagcatgtatcattcccttttactttctttctttttttttttctttttttatctgagacatcatctctctctgtcacccaggctggaatgcagtagctcgatcttggctcactgcagcctctgtctcccgggttcaagtgatcctcctgcctcagcctcccaagtagctgggattacaggtgtacaccactatgcccagctcttttttttttgtactttagtagagatgaggttttgcatgttggccaggctcgtcttgaactcctagcctcaagtgatccacccaccttggcctcccaaagtgctggggttacaggcatgagacaccacacctggccgtatcattcccttttatggcctaaaaatgttccatatattgttgatctcttcatccattgatggacagtctctgccttttggctattatgaataatgctgctgtaaacatttgtgtacaagtttccatgcggacacgtgtttttatttctttcgggcataatacctaggagtggaatggtaactcaaggtttcatcatttgaagatctgccaggctgttttccaaagcagctgatcaattttgctttcccaccagttgtatatgagggctctgatttctccacattcttgtcaacccttgtttttctctgacttttttattctagccatcctagtggatgtgaagtgatacctcattgtgaagcatgagggttttgctctgccttttttctatctcttgttcatttcagtggttatttggggagagctacccaggatggatgcgccggttgtgtacttaacagctccatggggtgcttttcatgtcagccctgttaactacgttcttctgccaggttaacttggaagactcttccaatctgcagcatgataattaaagtgtatttctatctgatttctctctggctcattccagtttacatttttgctgccccctaaataggcagcaaactcctgatccagatactcctggatctctctctcacccttgcccaagaccattcataaaaaggcataactaagagatgggattgaggccagtctgcttgacagctgcttctctagttcttccccaagggtccaaactagtactcagaatgctattgcctttcaccaggagcctgcctccttaccaaggagagcaaggctgtgtgtggtcagggtagcgggtggttggtcctgaggctggtccatagtcctggcaccttttacaggcagaaaagaaggacttgtgaagggaagagctgtctgagttggttataggctctgttcctggattccgatcctggctctaccacctgcgagaaatgtgtctttgggctgctcacctattctctcggagctccagtggttttatccataaaatgaggatgcacagcctaatggaacacacccctatgagttgttgtaaatactaatgcttgttgcatgcctagtacttagcatgtgatgagcagatcacagccagctttagtatccacagttatcatcagatgggtttcaggaatggttgagggtgggaggtgaaatcaaagtgtataaaacctggatgtggaatttaggattgtttgtcaacatgcctcattaactaggtctccagagtctttttaagcagtaaaaagaaggaaattctgccatttgcaacaacatgggtaaacctggagtacattatgctaagtgaagtaagccagacacgggacaaatactacctgataccagttataggaggaatctgaaatagtcaaattcatagagacagagagtagaatggtggtttccagtggctgggaaagagggaaatagggaaatattagtccaagggtataaagtttcagttatgcaagatgagtaagtcccagagatctactgtacagcatagagcctatagtttactgtattgcatgcttaaaaatttgctaaaagggtagatcttatgttaagtattatcacaataataataataataagagcaggaggaatcttttggaggtaatggatatgtttatatcatagtttgtggcgacggtttgacaggtgtacacttatttccaaactcatcaagttagatatgttaaatacatacagctttttgtatgccagtcatacctcaaaaagcggtctaaaccgaaaagaaatttgaaaaaaggacgagttcatgtcctttgtagggacatggatgaagttggaaaccatcattctgagcaaactatcgcaaggacagaaaaccaaacactgcatgttctcactcataggtgggaattgaacaatgagaacacttggacacggggtggggaacatcacacaccagggcctgtcgtggggtgcggggaagggggagggatagcattaggagatatacctaatgtaaatgacgagttaacgggtgcagcacaccaacatggcacatgtatacatatgtaacaaacctgcatgttgtgcacatgtaccctagaacttaaagtataataataataataaaaggaagttttggattaataaaaggaagttctcatttccttatcagttaaattagggcagatgggttaaatcatggttcttgagcttttttgaatcacctaggaagttatactcacgtgccaatgttcacaaaatgttgcacacattttaagggatgccccctttcccagacaccaggttagaaacctagagcatggataatctcagatgccctcatctagcttaagtattcttcactccatgtctgtggccatagcagaggccagagttcaagttcaagttcaggttatctctatctctcaggtcttcagttggctgggctggggagtagctagagaaaagaagtgatgccatctgcctcctggggcttgggagaggagcatttgaggtatgccaaagtgcttcatcaactgtgaatggcttcaccagtcattcttgtaactactttgctctatgaagaaatgcaggattgaattatgaatgctttatggattcaatgaattcctggaaagttgcaaacaaatcaggtttttgaaaatccatctctgcagcatctggtcatgacaccatttagaggagcccaacagtgaatcttcgactggggcagacagacattctgttgcaaagcagagcattcttccctattaaaatgccaacctgcagatagcagatttgctcagaggcaaagctggaagttcagagaggggcccagaagagtcctggttgattctgggtttcaggaatggttgagggtggttaatggagtcattaggaaaatcttggggctaacatccattgctctacaaagtggttaaagcatggactgtactgtcagagacccaagtttaaactccagcttcccgtgtggaaaattcctttgtggcctcaggcaggttaccaacagccctcagcctcagttttccaatctgtaaaaggaggataatcatagtagctgtgagaattaatagtgtgtcaaagcacttgacatagtgaaggtactccataagtggtagctgttaatgaggctttatttttattgtctttattaattattaccatggtctaaaatagcatgtggatccacctggaccatgcttcgctcagggggccaaactccatgcttttatgttatttttatgagcatctctcagtcttcattttagacagaactttgaggtcatttaggacagatttccactgagtgaggaagtccttttttcagcctccctgctagcaaatcatcccctggttgaacactcccattaacaggaagctcaccacctcacagggttcttgtcctatcttaggactcttctgcatgttagaccatcactttttgtgctgagttcaggcctgtatccctctagatgcatgcgcgttctaaccatcctgtccccacgacatggtcgtccttcccacatctgatgatgatggctctgctttctcaggcctcttcttctccaggctaagggagcctctcaccatgcaggttccccaggttatcagcctggttccgggttatcaaaggccttgtaccacaatgctcagagcttctgggctggtccaaagtgctgagttcagagggaccaaggagttgaccttgagggataaggcaagggaagtcactgggagaccagtcttctggggggcttgtcctgagcatctggccctgctgtcattcctggacccatgtcagtcccagaataggaagcccacagcctgctctctactcaggatggcctgggctcatcagtggcatgtaacgtggtccacaggccctgcgagatcctgcctgccctgcaccctctgcctagggcaccatctctctcttctctaagatctcagcttagactccatgtccccagaaaaggtcctcagtagattcccagatccagggctgcagctcagagatcccataatcccacataattctccaccatgggactggccatgccatatcacagtggcctctcttctgcgtcccgctaggctgtgagctttctaagagcaaagacactctctgcctgggtcaacattttatccccagagcctgtcactgtggcctctccctccatgacatttgttggttgaatgaatgaatgagtgaataaatgcttgatatgagacaatcccaattggtgggaaagataagccaaaaacacctgtcagaaaagctctagacctgaacccagcagacagtggtctcaggcggttcctatgtccttcacagccctcacccagtcctctctgtccagatgaaactgccaagactgattacaactcagtgttgaaccacaggcctcccaccaccccaaattagtaattaatatttgaactcttaataatcccgattatgatcacagtgctaacagtgactgttcactgagtgtcttccacttccattatgacagcagtgctacaaggttggtttttatccaattttatagataaggaaactgaggcatggtcagcaaagatctgcccaaggccactcagcttgtgtgcagtgaagctgaaattctagccaattcctctggctccatggctcttactaccctccatgtgctcctactactggctgtaggaactagagatgcttctcttttcccccaggagacaggggagcaatcagaaatgataatgtagggggagtagtgttatgataaaatccagggttctctgagattccaggggagggtccctgcagactggagcatcacttggggaaactgccatggaaggggaagcttgagttgcatgttttctctttttagttttctgagatttttaaaacacaaaggcagtacagtcttatagacaaattaagcaaaagcatccctgcttccctctttcctcccctccagagtaatgagagttgagattttgatgtgtatctcctagactatctatgctcatgtaaacatgcatagtggtgtgctggtagatgtttacaactgatggtgatggtgatggtgatggtgaggcaatgtgccaatttccatggtgtaaatgctccccccatggctgatttcaagctactagcatgaaatcactgaatgtgcaattgggaagaaatatgcaatcgcaactattgtatggtatttctactctgcagctacagtagaggccagtaccctagagagcatagaaaatcatcagtcaaatgtagtaaaataattgggaatggttaagttttgagtatttattgccttttaaaaatatatcatttattgaattgtaagtttatatcatttagtttttcaataatggctgtgtttgacaactggttcacaaaattcctgaaaatttaacagttggctctcagtcaacataagctggctccagcatagcactcatttcatttttactaaaatcttaacattttataattttttcttctttcttccttcctgccttccttcctttcttgtttctttccttccttctttccttctttctttcttcttttcttttcttttagaaacaggatcttgctttgtcacccgggcttgagtacagtggcacaatcatgggttactgcagcctcaaactcttgggcttaagcaatcctcctgcctcagcctcctgagtatctgggaccacaggcgtgcactaccacacttggctaattttttaaaaaattctttgtagagaggctgggcgcagtggctcatgcctgtaatcccagcactttgggaggccgaggtgggcggatcacgaggtcaggagatcaagaccatcctggctaacacggtgaaacgctgtctctactaaaaaaaaacacaaaaaaaattagtcaggcatggtggcaggcacccatagtcccagctacttgggaggctgagtcaggagaatggcgtgaacctgggaggcggagcttgcagtgagccgaggtgcaccactgcactccagcctgggtgatggagcgagactctgtctcaaaaaaaaaaaattctttgtagagacagggtctcgctatgttgcccaggcttgtctcaaactcctggcctcaagcaattctctggcctcagcctcccaaagtgatgggagtacaggtgtgagcatcacacttaaccaatttttttctctttaacttgctttttacttaaaaggctctttttcccatcattctttcattcaaccagtattccaccatgtgccatgccctccctgcgttaggaaccagggccaccattgtgatcagggcagccacgtgctttgcactcattagcttacggtctagccagggaggcagtcagttaccaaatcgacaaatagatatcaacaaaatgctcactgcaattagggctcttaagggaagttacaggatgatgtaacagagataatgccatgatagaccagggatgaggtatggccaggaagaacttcctttagggtcaaggctaggagaggcttcttctgtcaaactcacataatctgagacccaaaagctaagaagggaccacatattcaaagcttagtgggaaaaaattgaaaaaggatatgttcacttgggtgccatttctgtaaactttacacacatgcaaacagtcctgtatgttgctctttgaaaagtccttgtgtcataaaaatgggaaggcttcccaccatctctaggatggtggttactcttggagggaggaaaggaaagagaagaagttggaggcagagagggtcttccactgcatctcagcattttcttgaagcaaaaggagagagaggcctgagacaaatataactcgtgttaatttttcttggctttagctgatgggcacagggttgtcagctgcattcttctttataatttctgaatgcttgaaatatttcatgattattgttatttttaagggtagataaaagaggctctaggctcaccctcagggcatcaaggctgcagaaaagtgaaaaggaagtgagaggcccagggtaagttcgggggcaggcctgtagggtatgaaggctgtggccataaatatgagttttattgtaagtgcagtggatgccattttgagctggtgcgggacatgatctgatttacattgataaagggcttctctgctgctttgaagagaacgatggaggcttatgaatggcactaggttaggtaggagtctaggcatggtgactatccatctgtttcccatctcccaggagttctcccaggctctgcttcaccaagtcttcaggggaccaaccctgatctagctcatgtgtcaaaacttatcaagttgtaccttatatgtcaatgatgcctcaataaagctgttagaaaggaaaaagaaggaacatgtcactatgaaacagaaagaggcaggatgtataaaagggtggacctgaaaaaaaaactaattaaaaattctgggaatgaaaaatattcatcaaaataaaggtactcattaaaaaaaaaaacaaagaaagttggaaaaacctcagtagatgggagaaaccccggattagacacagccaaagagataattagtggactggaagagagctctgagatatttttccagagagtgcccagaataataaagagaaaaatatggaagagtagttaaaagacatgaaggatatattgagctactcccataatttttttttttttttttgagatggagtcttgctgtgtcacccaggctggagtgcagtggtgccatcttgactcactgcaagctccgcctcccgggttcacaccattctcctgcctcagcctcccaagtagctgggactacaggtgcccgccaccacacccagctaattttttttgccatacgtgtttaacagaaattgtactgaaagagaatggagaaaatggccgagaagctgtattcaaaagcctaatgactgagaattttccagaattgaaaaggatatgagtcttggagttgaaaggtgttcatcaagtagtaaggagaatttcaggaaagtaaatcttcacttcaaaaccacatagcaaaactgcagaaaatcaagagtaaaaggaaagtcttaaaatttaccacagacagattatccacaaaagaacaacattagactgacagctgttgcttttgcgccgatggcagtctttttagcagtcttcagagtgctgaaagaaaataaaacttagcctagaatttcatacccagctgaactctgattaaagagtgatgatgaaatgaaagagaaaccagccagcttcaaaccctgaggctcttgaacatttagaggttggggagaggaggaaccctctcaaatcacatatattcagtcatccagcagtggcctctgtctcccacagaaactgtaaggagagaaggattggtttagcctttgtagttgcagtgcgaggccagtggaaaagccccttgtcagccatgttgctgagtattccatcaagacagaggagggagatggtcccatctgcttcccatcttccaggaattcaaaacacctctgaagggctttgtgtgtctaggagaataggatctccagtgtctctagaagaatgggaatgggtggagggcaggtagcagagattctgaacccagcctgcatttcagttctgtagcagtggtgacatttcagggggagggggagggagcaggtgggaccaggccctgggccctggttgggaaggagcccagggacatgagaacccctctagaatggcccatcctagactctttctctttcttccagattgtggacaagaacaaccgctataagtccatagatggctcagacgagaccaaagccaactggatgaggtgagccctgctctgctgatgtcccgggggtcttgcctggcctctggaaaggagccaagggagtgtgttggacctgtgggagctccagtggtggagacttctggaggctgccgtttgcagggtttggatgcatctagctctgaaggacccaccttttcccctaggcctccatcagggggctctagaggacggcgtgtggtcaggccgttgggatgcagggaccgctcgggctgctcacttgccagtgtgtctggaggtcctgggccccaggctcctggcagcattcctagggaggaggaggagactgtcccccacctaggactgtgacacctcagagcaggctcctgcaggggtggtgtgagaatcgtcccagtgcagccccagcagttgtttaaacagcctccatggaagaaagggctctgacaaagtcttcagctcagtttttgacagtgttgctgcctatgtttgagtactttgaagtgtcaactttaccctgttccggtgtttgggacagaattttgcaccagaagttttcttaaatgccaaccagaggaggcaggagactggccccaggcagggtcacccagggatggctgagctgagcccagaaccatgggtccagcgtgatgctgatggtctgtgccatgtgcgagggactctgcctggtggggtttgtggacaggggtgggagatctgacatgccttgttgcctgcttggtggcctctctctgggacctaggagcactggctggagatttggatctgggtgggaggggaaggaagcctcagatgtctggagtcaggggcacagccacaccatgggcctggggccctctgccggcatttgcacagttttctgacccatggggccttgaggctggtggtgggattgtacttggagagagggcaacttcctaaaaaggagtgtgctgtcttaaactcggagactttctaagcaaatgaggagaagcaggtttgaggcgtagagtatgtgatgagggctcctgtgtccttcccagtggctccactgcccacctatactcctatcagagagtggctgagcagcagttcacacctcccagattactttagcgttcgccctcttatgggttagggaaggtgttctcattgccgtttgatgggtgcagaacagaggctccagagaccagcgggccccctgccttgcagtgtggagaatagcaccgactgcccccaacctccttggacacagctgatccgacactgccctgaaagtggccccagggaggtggcttgacaccctgactgccttctcttctcactgccacggggtccaggtcagctgagcacttacagttcatcacctgtgtactgagcacctagtttgagtcagactgtgaaatgggtaccagggtggatcacccagccctgccccaccacaccccatgccccacccccgctggcccttcccgggctcacacctcctaccacagaggtgactttccagtgtagtttttgcaccgaggcacaatgtgctgcagaggcccagatgaaagaggaggggttcgttgacatgggccttcaaaggggccaggattgtgtctggggacactgggttgtggtgtctagtcaggctgttgggcggctgctcagtttggaccccaagcctgtgctgctgtgctgcctgccctgtggctgcagcctggctccaggcaagcaggggagaccgtgcgtgtgtccacttgggaatcaggctttctgtgctattgcttttaaggcgccgggagctttgcccatagaaccgaatctgttccactctttcacccatctctgatctttccccctggggacaaggccttctcaaaaccccaaaaaaggggagctatcatccaaactaacttatctatcctctggcaccccgcagattgtgacttaattgggctggggattggccttgggccttggtatttttaaagctagtgattctgatgtgccactagcattgagaaccactgctctgtacagatcttcatgccacagtggtcaagctgagagcagggcaaggtcttgcttaagagcatacagtcagggtagcagaatcaggatttgaactcctggctctgtaatcctaggtcggtgttcttcctgcttgtgcacaagggaccaggtgaagcgtggcttcctgggcctggatgggcactggtgagcaggggtttgggggtttctgctactgccaccttgctagcatggtttctgtcctgttctgctcccagcctgtcctgattcaagatggcatctgggtagtcacagctggtgggctctcatcttatgaccactcaaagagcaggtttgggttagggatgcagtttgttgccacggagacgcccctcctgttgctgttggagtgacgggaaagctgttaatcctgggaatcctcctttcccttcatgtccagcttccgtggtgtggctctttctgacttgcagatgctctcctttgcactgtcatggcaccgcttggggatgattgaatggactctgttagtttcttaacaaaattaatggtgggccaggaggcgaatgggcactgtcgtgttgagcttatctttatgacagccccatctaggtgatctgtctgtggtggttctcaaccgagcactattttgtgcccctgggggcatttggcaaggcctggagacatgtttgatggttggatgctatcagatagaagccaaggatgttgataaaatcctgcattacacaggacaccccttccccccaacaaaaaattttctagccccaactgccaatagtggcaagattgagacacccacattaagtcctcctgatagccctggacagtgacactagaattgtcaccctagttttatggagaaggagactgggttcacacgagtcccatggcttggcccaaggagactcagtctctagttccaggtctagtcccatattcctgccaccatcttggactgggtaatgaggcccccagccttcttcccatcttctgggccctggtgttttgggtgcttgagtaggaaggtgagggctgaaggatgttggtgccgccggccttcccctcttggtttcagaaggaaaccaaggagtgaatgcgctctgagctttcctccataccctcatgtcctctcttgggtggattttttaaccttttatcactagttaaaagggtgacagagccacgatgtggagaaatcaagttccaaagccagagcaggagccaagtgggatggaagggccatgctgtgccccttgcccagggcctctggctgctcagttgagagggaatcccaggtccccctggtgtccaccaaagtggaacttgactccctcaggacagtcgtgggcttctcaaattctaccaaaaagtcacagcagcccacccccgaagaaagcactcccatgggaaggaaacctgtttgcctgcacatatgcaaaggtgggggcttggagaactgaccgggacggggaaggggaagagagccactaggcagaataagctttctgtggccacaccctaatcatggcattgtcactgctacacccaacggtagccagtgtaaatagtttccctggttacgtattcttccgagccattcattcagctgtagggctgtaggtaaatatcgctttatagaggcaatgggctaatcctaatttcaataagatcctttactgctatctttaagagattttaagccccttacatcatgatgtttttccctccttagtaataaacccgaagagttgtggttgttattctggacagggagaataaggtgtgaaaggttgaacatgaactgccctagctctcaccgctagtaagagctaaagcaggccctgaaaccaaggccttcgactctgagttcagtgctccctcccatgtaacgccgtctcttctttccaccctcccctccgaggagtagtggaagggacctctcagtaggaggagggtgtggtgggggccaggttgccccaggtgcctcctggctccccagctgggggccagcaattaggaaggagaaccacctgcattgacggtcatttacccaattgtgctttgtgggatattcaacccaaggaatgtggcacacctggctgagcgtaagaggaagcccaagttctccaaggaggagctggacattcttgtcacagaggtgacccaccatgaagcagtgctctttgggagggagaccatgcggctgtcccatgctgacagggacaagatttgggaaggcatagcccggaaaatcacctccgtcagccaggtgccccgctccgtcaaggacattaagcacagatgggatgacatgaaacggaggaccaaggacaagctggccttcatgcagcagtccctgtcgggccctggggccgggggccgggcccccaccatcgtgctcacggcccacgagagggccatcaagtcggcgctgctcacggcccgtgcagggcgcggcttccccagggcggaactggatggcaccgacagcccttcgaccagctgtgagtatcaccagtcccccccgccacccagccggctgcctgccccccagcttacagtccacagtctcccaccgactttccctctggttctctcctgtccctctctgtccagcccactctttccatcctcccctccttctcccactcttctcctctccatccctttttgcattcattctcgaatatttactgagcatctccgtgccagagccgtgctaggagctgggaagacagctgtgtgtaaaccccacgcaggccctgctcttggggagaccctggactcctaggaataaaccaacgttaaataattgcacgagtaaactggaaacgaagggatggaggacacaggagtccaggaggtcccgagagcagggctgacttcatgagcatgcaacctgaacagtcacaggggccgcggggtttcaggctctgctgtcgccatctggacattcttcatagtttttgagccaggggccccacgttttcattttgcatttgaccctgcaggttatgtagcagctctgtctgagagttaaggagtgggtaaaactggctccactggggactggggagggctccctgaagaagtccagcggactaggatgtgaagagtaagagttaaccaggccaggcagcagcgtggggcgcggagaaggggaggggaggcgcgcaggcagagaacagcatgtacgaggccccgcatcaggaaggcgcttggcacgttccaggaacagtgagaagccaggaaagcccaagtgtagcagcgcgggggagggggctggagacgaggcggccaagctgtgaaggcccgggccgggccatggaaagatcagttcctttctgtgtctggtcctgactgctttgttcctctattattactcccctgcctgagccacgctgcctgcccccacttttctgtgtgctgcctctcagctccctctccatcctcctggctgctccgccacccgctccccacccctcttctccctctgtacttgtccctgcctttcctctctacttcctgtgtctcacatgcactttgaagccagggccccagcggccgaggcgggtgtcccttggggctggagttctagttggggctcagcagaagggggagcactaaaggcctccgcagggactgcaacccttcctttccacttctgcacatctcccccgtgccccgccagctgcagtccccactagaggccgtctgcctgaccggctcgtgagtggtgggagccaggcaggaggggccccggggaagcagccgtggctcagcccatgggaaggtgctttgcaaagactcacttgcaccttcccttcccgggccccctgccattgtgatccacttgcttcctgtttggctggggctcctgacaggtggcagttcacagagtcagatgtttaggactggaaaagaacatggagaccatttagttcaacttccttgcaatgcagaaagtaagctctgaaaaccaaggtggccctgagctcaattcagaagcaggacttgaacccgggtctgctggcttcctgtgaatcagtgttttcctaagtcttaagaggattccaccccgtgataagaaaaaatgggggggtcagcatccagtaaagcctgttccctgcatcctgctccgctcacccctccatctccctgagactgaatgtaatgaggccaccaaaggtaacctgggctggcagggagcccgagtgtgccatcaggcagagcccgctcacccccatggcaggctcacagccctccttttcctggcagtggccagctgcggcagcactcggccaggggcttggcagaacggggacctgggagggaaggagcagcatcacctcgccgggtctcactccttccaacactggccatgctagacaggtctctgggatctcaggggatggctgctgtcccaccaaacactgccaagagacacaggactcttaccaagctggcccaagtgagcccccaggacccctgggaggcatgaggtaactgtaagataaacctgtctgtcctccccatcaccttcctggggggtggttctgagttgagtccgcagatccaggcagggagggcttgcctgtcagtagggtcagcccatacatcatttaatcctgccacagggatcagcccatacccttggtcaccagaaagcaggacccacatgtgcagaggctgggccccctccctgtgtccggctgcaaggagcagtctgtccgatggcccctgtgcggtcagatgctcctggatgggagcacgatgtgactgaactggaagcctgccttgggggacagggggacagcagggctggttgcagaggtggctctcctgctctgcactgtcctgccagtttcttcagcctgtcagcatgtgctgcagtgatttaaagatgcagattccatattagtagtcttttatccctcacccccttcccactcttccccccaagtccgcaaagtccgttgtatcaatcttatgcctttgtgtcatatggcacagtgtatactgcttgggtcatgggtgcaccaaaatctcacaagtcaccactgaagaacttcctcatgtaaccaaacaccacctgtaccccaataacttatggaaaaaaaagtgtgcagattccagcaaggccacaagatggccccaagcaatgcagacgtggcctcagaaagtctggtgctcagagggccaagagcgtcttagtacctttaggcaggtgccgctccttcagcgttacagagcaccttcatgtttgtcatcttgtttatgactcttcttaacaacccaattaggtagccaagcggttcgatgtgtagacagggcagtcgttatctttgcagaaagtgaggtgcagagagatgaactgactgctgaggtcaggagctgctgggttggcacgcagccggtgggccacggtctccaagtcccctggcctgggctcttccccactagaatagagctgttccgttgagaggaagaggaacttccccccagggatgctgggcccacgcacctcagggatttggggaacgtggatttctctatgggcgggggccaaactagaccgcagggtggcagggcagggggatactcaggtgtttttcaggggcagggccaacccctgggcctccctccttctcccttttgtaaccacttttccatctttgtttctgtcccccaagatgatgaagatgaggaggcgcctgggccctcaaggcagcctcttcgggtgcctctgcagcggtctccggaggaagaggcccacctggccaggcccgccctgctccgttcatcctcctcctcagaccagtctgagacggtgggccccaagccagaggccctgccccatccctcgccccaggcccaggctgcctgcaggacccctcggccgcaccccagcccacccaccacgggccttgactggcagctcctccacgtccatgcccagcagaccgaggtgttccggcagttctgccaggagctggtgaccgtgcaccgggacatggccaacagcatgcacgtcatcggccaggccatggccgagctgaccagccgtgtcggtcagatgtgccagacgctgacagagatccgggatggggttcaggcatctcagcgggggccagaaggggcagaccctacgggctccactccccaggccacccaggcccaagcccccctgccagagcccccaccagcttccccagcatcagcccccacacggactaccaggtctcggaagagaaagcacaatttctaacccagctagtctgcactaggaggaagagtcatggaggagggatgtctggcctcacaacaggggccagtctttcgtgtccaggaacaggatcgatgacccttgtaggacactgggggcgctgttacctcctcaccgagcgcaggtcgctgccctgtggtctaacagagcatgtattcagacccgcaccctcatctttggcggatgctgaagatgcaagaaaagccacctgcttgatgcttgcttggcctggagatcgttctcctcttggtctgtgtcccgtggcggcaggccttgcagggaggggggcgcaacagtggggagcatccgaatggagtcccactttccaaccttggggctgctgcatcggcctcccacatgtgacctcccaggccctgatgctgcttcttttgaagggggtgaggcctgatgggcaggtcaagtcggtccttcagggaggggtctaccctcccttgcccgggggtggtgcccgccttggccctccgcttgcccttgtgcgcgtgctcagctgctgtgcttgccttttttggagtggggagaagaatgggatgacgtcggaggaaggaaaagactgtcttgcattcatagagagcactttatgcttttcctcgcccttgcagagtctgggtggtctcagtgggggctcaggacagtcagctcaagacagccaagtcaggtattattatgatcatttttatcatcatcatctgtataagacaaatgacacagccagttagtgagagggccaggactggaagccagggtatcggttttcccagctcccctgtcagaggccagatctggagtagtgggaagaggaggcagggggcaggtcttgccccttgccaggcctctgccccttgccaggcctctgccccctgtatctctgcttctgcctcagctgtcctgggtgaggtgggaggcacctagcatttagcaggtgattctcccaccctgccctggctctatggctcatagccagtggcttggagaggcagggccagatctcaggagtggagggcaacctcttccctggcttctaaaagaatccagagcccagtggggctcatgtcccattccaggttccagcatgccttgcctctgcttgctcgggctgcctacgcactagctacatacacctctagcttcatgtttcatgttggagtgtggggagaaaactgggttcttagcattagagagggaagtggcaggtggcagatacaagcttagctctgacctgggtgcacctcagctctgtgtccttttttttccctgacctgaagctgaccccagcagaagtcccccagccaacccctccacccaacaaccccccaccctcccatcctgcccccagccatagtgggagctgggaggattgcagcatctagtgccttccaaggctgttcctggagcgctgcttgtaaacccaagccaagctttgtcccacgtagggagaatggaaggtgactgcaatgtccctgtgcctttggctccatctccccattctgtggttctttgggggttcctgcttccctcaaactgaacactctcctgtccaacagcctgatggcttaattattgcctggaattgcccggcctccgatgctggaatcaaagattgccttccgaagtatttttgttaagatggcaataaaaagaaatcaatctcactctttgaacacacccagtgtccaggatctttctttggtgtgtattctctttcttcgtttcctgtgaaaacctcgaggaccccaaagcaggggttagatgtttaaggaaaagcaggttggtgagaagggctcaagtgccccttgatttccctgattctataaactgccagattccctgtatccagcaccatgccaggccctcggaggaaaggaagggcatgcatgcacgaaaccactcagttatatttcatttctctgctcaaaagtgaggtgttgctaagtcaattttaccttttgttccctaaaagtaagcgagaagttctggaaaaacaatcaccgtttcggacaggaggctctagaagggtcaggggctgtccatgtgccagtgcactttaggggccacctggaggcatgaccctccccaccaatccaggtgtctgtgtgtctggcactggcaaggctctgcccacctagatctgaggcttctcaaagtaaccaaagctgcctcctctgccaagaggaagcctcctcacctgtgcattgccctggcttaataccagtctcagagagcttctctcaggcaggaaatcccctagtcttgcccacagatcccctttctagaaggttctaacttgccatcctccacagttcttggccaaaaagcatggccatagaaatggaggactacccaatttccgagagatgcaaagatgtcgtgaaaccattcccagggccttctctcccaaggtcaatgtatgaagcagtgactggctggctgctctctctcttcctggggagggaaggagccaaattggaagctgtaaaactgaaatggaagtcagagcaaaagggacagtgaggacttgtcaacttgggatggaaaagattttcagtttctgtttcttggcttcagtggggattgttgggctagcacattaaaacaggaagaggaaacttgggtgagagacagaaatgaattggaagagggaggcctctagccatgaccaggtgaccatctggtgggtggatgtgtgacccaaagcccctcctagcccggagacctatgcatgtgagaacacagagcccagcctcttctcagtcggtcttttcctagttctgcctccttaactggggcagcttcctttgtattgaagatacccactatgcaatagtgtctgagcctggcctagtcaattccctccagcaaaatggatgccctgtgttatgttttctttgcgttagaaacaatagtcatgtgctgacccagctagaaaatatgatgcacttgataagacacagtgggtgaggtctgagaattgttgtcttagtacttacctatccagtccccaaggtcagctgggaggttggaataaaaacaatccaggatcatcatgacaggtttagtccagagctctccaccgccatcagcagcaccaccaccttccccttgattgctccaaaggtcccaaattctgtgggttggagttgaaatgcctcaataagcactagcatttgcagaacagtctcagccaggcattctctgtgccttctctcaagaggtagtgacctggtaactcttcaaacctccttgcaaagagctgctcagccacagtggatagattttgcccctcctggtagccttccactccttggggagggcttctgatttctgcagccatgtaatgaatggaacaggcacagttcttcataaaggggttgttgtgaatggggacagaagggttctggggggtggtcgagccagcaggtgttaaggcaaaacacttaaaagcaggagatctaatcagaggtaacaggtctggggacctagctggcttcatttagctttacctcttaaatggtataacataaacatcttgtcaggggaatgggttgtgattcaccaagagttgccatatacattgtatttcaaatgctaagtttcagaacaacaaatacaacaaaatctgaataagcattgatctgcctttgaaaatactttgtgatttatacaacgccttgaggttagctttccaaatattgattcttgatggatagaaaaagaccagaagatggaaagttaaattgacttgagtctttctaaaccttttgacacaccctagaagttgctcttttgaataaataaatcccagataggaatgtatttctcatctagctttttctcttgatgtcaagtgtcagagaaataattctagcttttagaggttggtggttgtttagaaactggaagaaaaaaaggagaagacagtattctccaatcatagtgctatgattcaagtgagtcttgtgagaaaaaagacgaatgaatggtttcccttttgtatctgggagcaggaaagtttggaacaacttctattctgtgctaaccgcaaggttgattatttttggatgtcaaatcctagactctcactaaattggggactggaaatattttgcatattcagaagaaatctcagctatggagaaaagactgactcacagttgtagaattgagattgggaattattaatttggagtgacttctctcactccaaattaaaggaaaaggggctcttttcctttctcttaagtcctttgttaataacatcctggctgggtgcgtggaaatcaccctgtggtcttcactactcagggatagcgatgcttatatccgatgtgataagaacaccgatgtgttggggctaacagagaacacagacctaggacaagatgcaaattctggcggatctaagcaccgtaaatcttgcaagttctacacctccatggtggagcctgtggcttgcttctctcaaaaggttgaagcagccaaagccagcatttgctctcccatctgccttggtcttactccttctgaggtcttgcagcatcctgttgccagaatggattgttccctggactccagtgatcctccttggaaggcaacagcctcctcccaggctctccagatgagcaaggcaggatatagatgaggggcagctggtgccatccctgggacctctagaatgtagattctccatgctgctagctgccaccactgtcacctcatactggaattggcattcgtatatttcttttctttatatgtgtgtcaggagtgaggtgcgtgacagtaatagttgcttattgagggaaactttgaaagtatgcaaaattacaaagatgatccacctgtaaggggttgtcactgttaaaacattggtatatttccttcaagtcgtttactggggcttgtttttaaagcattattggaaccatagtctacttccagtcctattgttctcacactatcttatttcaacaccatttttccatgtcataaaagattctttgaaaacatttttctatagatgaatagcattccattatataaatgtaacatcatttacgaaatcttatctagtattagacatttaaatgttttgcctttgtactgctatacacaatgatacaagtcagcatattggtatgccgggtttgcatacttcatccataacttatgtttcttgagccatattgccaaattgtttcctaaagggttgcacctgttaattctgcatcatcagtacaggagacacctttcttaccacctttaccaatagagatattatcatcttttagaaatctgtgccaatgagacaatgtactacgctgtgtttcttttattagtgatgctgaatacttttcatttgtttattatccatctgaattcttctgtgaatttttgtttcccctggacttttccagatataattcattgggctacaccaatcagacagactttgatttttgtcccttgtttttgagacaaaccataacataaagaagtttattttttactacaaatttcctaggtgcttgtgtagctcagaaccctaaaacgtcaactaatttcctcttgccctctgatctgtacaccttcactcctcggcaggtgttccctcatcccaccttttggaggtgggtagggtggtgggctggatgtcgcacatgttgtttcagtgagaatgggcgagggccatagattctgagggtttgacagaactttaaaggttttctgggcattgccgagttggtgctttacatgcccacataggagccatgagttacagtgggaaacgtgcataggactcaaagctccatctcccatttattagctgtgtgactttgggcaagttgcttggcctctctgagcctcagtctccttaccttaaaatcatttagtaagattaaccagtggttgtcaaccttttgtagtctgttatttaccttcctcccctgtccccactggagcccccattttttaaaagattttgatctttagcatttattaattgatctcttggacaccttgtcacaggggctatttcagcaaggctttgtgaaatactggaaacagttgaaggaccccagccttaccaccttcagaggcctgtgggtatctgggaaccccagtggttaaaagttagtgaagagtagaagagataacctttcagtttttcaatcacttataatatttagttgatatattttccatatggtgtgaggcaggcagggcaggtgtcatatccagtctcagaaaacagagattcttagaggtttggagatctgcttgaggtcccacaacacggtgacgttgggacagggatgggttctggctggtgctgcttctccggacagggcagctgctctgctgatgttcacatgggcccacgtgcctgtggacttctaaccatccacacttgcccagcactgtgccggcaccagcgggcactcaacaaagggtggcccgtgcgttctcacctgtctcccctccccaccaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggtgagtgccatgctccacatgagctgcgcccacctctgagccccaggggaggcctggatagcttgttttggagcttcctgagaaatacggttcccagcaatgggaagacccagagtgattcgggggaacagatggttgaggtctgagcagcagctctgggccaagcaggggccaccccagcatgttatcgacccctagaaatggtctcagaaatccttaccacacacatttcagagtattcatgagagagacgcccccaaaaccgagcaaatatgtttaatcaaaatgtaccctatttccccaactccagttgatgaaaagatgttacaaactgccactgcctcaataatgatcgtaataataggtaacatttactaaatactcaatatgtgaaatactgacaacagtccaaggaccccagtctaccaccgtcagaggcctgttgggtatctgggaacccctgtggttaaaagtttgtgaagagtagaagaaatgacctttcattttttcagttacctgcaatatctggtgttgatatattttccatagcctgtgagcagattttctgcatgttcccatgtaattatcatagcagccatccctaccctgtcagtgcaccctgagaagtagatggagtcatggacatgtggcatttaggacaatgcccacctccatcatcagaagtcctcagctataaacttttaatactcatgatcccacatgcattcttttacccatcttacagatgtgcaaaccgaatatcaaatgaatacagtgattcatccagggccacctggctaggaaggacagaactaggtttctaatccatattggtctgacttcaaggtctaagttctgacctgcaatgttacctgatgtcccagacaaaaccagtcccctcctgggttcctcctggtgtctgtactgcagtcctaatgagatgaggtgaaaaaacaatctctatcaaaagaagaaggttggcaggaggtgggatggtgacttaggtgtgggaagccgggtgggttcggtgtccatccagaagcagttttaactactctcagcccctagtcctttacccttttattccatcctcatcctgaccagtgtagactggtgagtccaggcccttctttcaagggtgttttttttgtttgtttgtttgtttttttccccactaaaaccacgcatccaaacacctagagtctatctggtgccaggaaccaaggctgttcccaagcctcaccatatcgtgttcctgaccaacttactaattggaaataaatcttcacttggaatatgaggggagaagatgaaaagggggtgggagtgacttattcaaattaagctatctttaaaagcaaaacagagcaaagcaaattgtggacattgagtgcacagctgctgcctgacttggtaaaaggtatctggagatgatgggcagtaaaaggagaccccataaacatactcatttcttgtcttctttggatctcagggtttggcacatgttggtttcacttggcaaggtgtgcttccatgatgaggctgcagtggtttccatgtgacctctggagatgcctcatgtaaaagtgcctgatacatagtagggactcaataagtctttgttgaatggataaaagaagaaatgaatgaagacagccaagaagctttccaaagaatcataccactagaagaaaagaaaacccagagaaatcatatctgagaacacagatttcatcccttggtcataaccttcttgcattcttctggatttgtgatgtccttttcttcccctcagtggtcttctccagagcacctgaagctgcatcatcctccatgagccccaagaccacaggggattgctcagagaagggtgtgagctttctggagtggttcaaaggaggcgtgtcagacagacttgaaaggagatacaccgagacatatgaagatacaggagggaagagggtctattcctggtcaggctgagcagtaagaaataggaaggaaattgaaagtcacagtggggcagtttcacagctgtgggtgatcctgaagcccttgggaatggtcatggagctcagtggcttttaaatgtgtgcctctatagcctgtagcttcagcggactctggttagtggtgtcccagatgggtgtgccattgctgctctgaaagggagatcccctatgcccaatcactcttggtcttatatagaaggaggtttctttgtaattggaggttggcaccctgatggagtccagagcatgaattattagttcttattaagtagggatattggttgttgccagaagtcttcctgaagagagtgtaaactattcctttgtggttaccttttaagaatagattgcatctaaagctcgcattcaaacaatttatgttatttgacctactttgattcactaatttactttgaggttttctttgtttttgttttccatgttgtatggaggctttggaaccaatttcatgatgcttaaaggtctcttttggcctgtagatttttctgaaagccttaagtccacaaagatcatactaagaaatttgaacaacgttgttttcaaacaatgacgaggaatctctggtgatttctaggcttgatttcccgatgtcctcagttgtttgctgcctgattgtcccatgaggaaaggaaaatgtggctcttgatttttagagattttcaatgggcaagtgctgcatctgatctgtaagacatacaggtggcattttcaagttatctccatctctcccctttctgtagctcagctgatatagaagtgcaggctgtggggagctgcctgggttccagaagccttggagataaagttgttccttaggtattcatgtgaggacagaaaaggtgcatcctgaatagataactcccttttgtgctgtaacctaaaggaaacctgaagtcaaacatggggcagggcacagcacccataccagctatgggaaaccagacgtggaacatctggactgcttattggcaaacccttggccttcaatcagaagtcttttgcaaatggagccatcagaagcctaagtacgttttagttcaagtcattgttcagcggcacatcacctagggcccctgcacctggtctaggaaacctttgagatttctgagttccataggctactttcaggaccctctaagggctgaagagattcctctgcctttttagcatctctcaccagcaagcatcagcacttctgtggcagtttatgaaactatgttggtaatttttaaagaatcaggctagctgggtgccatggctcatgcctgtaatctcagcactttgggaggccaaggtgggcagatggcttgagcctaggagtttgagaccagcctgggcaacatggcgaaaccctatctccacaaaaagtacaaaaattagggtgtgatggcttgtgtctgtagtcccagctacttgggaggctgaagtggggggatcacttgagcctggaaggtggaggctgcgtgagcaccactgcacttcagcctggacaacagagtgggtctctgtctcaaaaaataaaaattaaaaacaaggaatcagtctaaaataatttatggttgaggagctcaccaaagtctttgaaacaattgaaagtaattcaaagtgaattgaggtaattcacatgatagaaagaaataggcaaggaaacgtcctttgaattgccaagtgaggagacatggctatatttcctgactgctttgggtcattatggctaccttgtcctttatcttgtcggaggctgccatgttggagccctcagcgccataggtctccttgtcttcccctttcttctgcccttagtcgtcagtgagaacaacagaagttcagatcatgctttctcacatgttcctagtctgctgattgctgggagaattagaaaggacagttgccataggatggactttgccttaagtaggctgtctccagagcaacgaaggaggaggaaggagtgaggcctatggtgtttcatgtgtaccttttaccaagtcgaagcagccatcttgtcattgctagggctgaggggaagctgcaaaggttgggggagttgatactcacttggctctgaggtatgttcccaccacccagtgtgattaagtgggatgttgttttctagggtcataggaaagaatgttcaattactctcccttatagatttctcttaacttataaccgtagagcttgtagacatgaggcttcttggaaactgtctctttctaaaaggtctttccaccgttcaggtcctatgagtctagctctgatggaccactgagtgattcgtatctcccctttgcaacacttgccccaaaagcccagatctagagggatgtgtcaggtgacctaacaggaggcctgctttgttttctgttggtttctccaatttgggggttttccccatttccttacaccctggttttccttcctaggagagaagaggttgcagagggagaagtctgagcaggttctggataacccagaagacctgaggggtcccattcatctctctgtgctgagacagggcaaaagtccctacaagcgtggctttgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcaggtaagttggtttggatgagattattgtcggagggcagagtacgcagtgggctgtgtggagggtagcctaaagctctctgtggaaaccaccttccgggagacctgaggagtgtaacgtggaggcggctacctccgtgggtgggagcccaggtcctcagtgtctctggcagacccatcggcagctctgccaggtgctccatgtgttgcccttgtatcctccttgtcaataaaggaagttccgctgcagaaggggtgtgtgctgtgttcttgacccgttgcctttctctggtactggtgtcttaccccaaagcccaatttctaaacccagtctttctctgtccccagtctcaagcagggtgtcccactggagagatctcttggcttccctaacttagtccaggaacacagccttgttcttctcttcctgaatctctgtcctgccacacatggtcccagttccctagcctggagttctggaaggatggagagtgaggggatccaggccattcacctgcatggctttgccctattctgttggctacctggatttctagagttggtcgacaactaggcaggtgttctagttcatatctgcagctgagggagactgtttacatagcacttactcttttaaccacatcccttagctcagaatgaggtgtttcttgtattcaaagcatgcgtctgaactaaactgcattttgatcctgaaatcacttggggccatatccaagatgcctttgttcacattaatgaagggcaaatgaatcccaagtccttgccatataactttggaatgtgtgatgtgcttttcctcctccattagatctactctcctagcttgtgctgtccagttgatagggggcatttaaatccctcaaacacccacacatggagggcaagggcaggcagcctgaaatctggtgggtgtgacaaggcaaccgtggacaatcacagggagagtaaaagtcacatgggcaagcaggagtgctcataaactaattctgggctgggattcaatccatcataggcttccacggacttctgtttcccatggtgtggcacctaccttccaggagtgtttcctgtggattttggaaaagcctgttttctcccccaggtataaatgtttctttcccatttgtttttcagcctcagaaagcatggtctccggccccgccatcatggaggatgatgaccaggaagtcgattcagcagatgaatctgtctccaatgatatgatgacagcgacggatgagccctccaagatgtcatcggccaccgggcgccgaatccggcgctttaagcaggaatggctgaagaagttctggttcctgcggtactccccaaccctcaatgagatgtggtgccacgtctgccgccagtacacggtgcagtcctcacgcacctcggccttcatcattggctccaagcagtttaagattcacaccatcaaacttcacagccagagcaacctgcacaagaagtgcctgcaactgtacaagctccgcatgcacccggagaagacagaggagatgtgtcgcaacatgaccctgctcttcaacaccgcctaccacctggccttggagggcaggccctacctggacttccggcccctggcggagctgctgaggaagtgtgagctcaaggtggtggaccagtacatgaatgagggagactgccagatcctcatccatcacatcgcccgggccctgcgggaagacctggtggagcgcatccgccagtcaccttgcctcagcgtcatcctggatgggcagagcgacgacctgctggccgacacggtggctgtctatgttcagtacaccagcagtgatgggcccccggccacagagttcctgtccctgcaggagctgggattctctagcacagaaagctatctccaggcacttgaccgggccttctcggccttgggcatccggttgcaggatgaaaagccaactgttggcttgggtgtagacggagccaacatcacagccagcctccgtgccagcatgttcatgaccatccgcaagacgctgccctggctgctgtgcctgcccttcatggtgcaccggccccacctggagatcctggatgccatcagcgggaaggagctcccatgcctggaggagctggagaacaacctgaagcagctgctgagcttctaccgctactcaccgcgcctcatgtgcgagctgcggtccacggcggccaccctttgtgaggagacagagttcctgggcgatatccgggcagtgcggtggatcatcggcgagcagaacgtcctcaacgctctcatcaaggactacctggaggtggtggcccatctcaaggaggtcagcagccagacccagcgggcagacgcctcggccatcgcactggccctgctgcagttcctcatggactaccagtccatcaagctcatctacttcctgctggacgtgattgctgtgctctcgcgtctggcctacatcttccagggcgagtacctgctggtgtcccaggtggatgacaagatcgaggaggccatccaggagatcagccggctggctgactccccgggagaatacctgcaggagttcgaggagaatttccgagagagcttcaacgggatcgccatgaagaacctcagggtggctgaagccaagttccagtccatcagggagaagatctgccagaagacccaggtcatcctggctcagaggttcgactcccgcagccggatctttgtgaaggcctgccaggtgtttgacctggctgcctggcccaggagcagtgaggagctgatgagctatggcaaggaggatatggtgcaaatatttgatcacctggaggccatcccgaccttttcccgggatgtctgtagggaagggctggacccccggggtagtctgttgatggagtggcgagaactcaaggccgattactacaccaaaaatggcttcaaagacctgatcagccacatttgcaagtacaaacagaggtttccactcttgaacaagatcatccaggttcttaaagtcctccccacttccaccgcttgctgcgagaaaggccgcaatgccctccagcgagttcgcaaaaaccaccgctcccgcctgaccctggagcagcttagcgacctgttgacaatcgctgtaaacggaccgccaatcaccaactttgatgccaagcgagccctggacagctggtttgaggagaagtctgggaacagttacgcgctgtctgcagaagtcctcagtaggatgtctgcgctggagcagaagccagcactacagaccatggaccacgggacggagttttaccccgacatttagggagctggcgctgcagagttcactaagctgttgaatatttttttaatctatactcataagctttgatatattatataaatatatattatattatattatattatatatatatatatatataaactcacactgaaaatttttaaaaaccaaggtgacgcgtccaccagaagccactgggagatttcagaaaggaaaaatgttggaaactgactcttgtctacaaaatttggcagctgcaacatacatggcaactcattttcactcacagaagcacgtgctggggcctcctgtgttcccaccttactgtccaccaacagcataagctaaaatgacaggtctctgtcatcacctttaggtagctcattttgtttatgttttcatttgcgggtggcggggctctgggtttgggtttatgttcttgccttttcttttttcatttggttttatgatgggagggagctcctcagcctcctcattgacattctggtccggctgaatcagatctctgacttaagtcagggtgggttgtctgtctgcatttgggaggcaggggggttgacctttctccctccccacctgacttcagcttgagatctttttttattcatttcctgatgagggttccttcactgtcctacaaacaaaagtgtcggtcaaactgtgacactgccacacctcacctctgttgcctcgtccatccctgggttgtggatcccttccttccagccccccctggaaactcacaatattacccattatactgaaggcaacattgcctcaccgctgagcttgaaatcctggggaagggagaaggggtaagcttttagcattcctgtttttacgaggtggaggataaaacaatataattccattccaatccagggcttttggggagatgaagagccaagaagtccagaccccaacaggggagtgatttttggctaaaaaacaaggaaaatgaaaagtacatattcgagttacatggattatttatactttttctttataatcatatcatgtgttgagggtattttttttcctttaataatcaagaaatgcctgctatagttcagtggcaggtagtgtcaatgcaaattgtgccctaagttatgcataactcaaatgagagtctgtagagatgtggtcctccttttgcaacaaggctgataacatgctacatggtcataggaaactggggaatgtgtctctgcctgtaaactcttccttttttgaacagggtagagatgtcctaaagaaatggagaaaagaagagaggactctcaaggcatcagcctacacagacacacacacacacacagacacacacacacacacacagacacacacacacacacacaatcacaatatacaatataagctttagaaatagccacttgcctattccctggggcaagtagtggtttaaactagaggagtctgatcaatgctctttcattcatttaactaccggtatacctcgcaagggagttttaaaaaatgtgcgtgagctgttaaaaacttctgttcatgttcctacatctgatttatgcatattttatatgcagagatcctatcacgtggatgcaggtcattttgggggagggaggaagatctgaattatatacatgtggtcagttctgctgagagcttcatctcttggttggcagagggtggtgttatctggccacaggcaaggccccaatgtcttcagcctgcttggttcagacattataaaactgtggtggcttccttccttcttggtttatgttgtctctgaggcctcatgccaccgttgagaaccatagtggaaatgtcatcaacactgaacatgttatagccctttcttggttccaccagtcccttcatcccctaccaatcccttccccttcacctccatggtcttggtgctaagataactttagaatcattgctgctagtcaatagcttttcattatataaatatattatatatattatatattatttttgaaatatttttgtttgttttcaacagtgatgtagcatgttaaaaaacaaaaaacaaaaaaaaatgggttcctccaactgtcccactgccaggcctcatatgctgccttcttcaacaaatcaatgcacccctgcctggtgacatccaccccacctcccaacccagttgcacacatgcttccctaccctcctctgagcaagaagacagttagcaggaactagcaaggaaaggctgaaagcctccttctgaggctttgagattcccagccccattccacttccccactttaaactgatgtctccctccatctgctcctcccatcagggtcaaaacctaactgtggtcaaatgggatgctgttgcaaagcaccaggtcccacctggcccagccccagccttgggacttcctctcccctcacacacgcaaactgctgtgtctggggagttttcactgaacattgcagagactaagaagggttgagggcagagatggctagcaagacagggcttggtgagggcagaaacagtaggttgagatcctttcttctagccaacagttgccttacaccttacattgggtaatgggtagggaggagcaggctaaggctcccgctcatttgaaaaccaggaagagagaaccagtgtcttcctgagcacctggtcagttggagctactctttttcctctcaagagatcatggccaaaatgagctaaaatcttcagctagaaggggaaaagcttatgggccagtgccagtgcctaccctgtagttcctgagaaagctgagagcaggtgacccacttctggcctagcagaatgagctgctatgcacagcatgcagctgcaggggtcacttcctgagctggccaccagacctcggaaaagctaacctctcaggtggtcttgaagttaggttagggcatccctaaaactctgggtgcttgtggcttctgctgaatttagccatgccagggctgtggcagacactctgtaggccacactgccatgggacagggaataatttgggtgatacaccactgcaatttacacggggtctcttctcagcttggatgctccctgggaggcccagtgcttctgtcctgtgaattctgcatgtgattacccatgatttctgtcataggcatttcccactcttctgcttgcttgagaaggacttggactgatgggacactcagggtctagcccagggagcatatgcttggctaacctaatctccccttgatgtgtatacagaactgtggaaaagcagttggtggatcccaaatgttgttacttcagacaagacagagccctttaactcagcctctggcttaggagtgatgactacaggcttagaatgaagtgtgtctctggggctgagacttggcataactgggctggctgattagtgactttctttggctcgtagggttggtgggaagtgagatcaaccttgaggcccaggtttgtggccaactgtgccaaggtgatacctggcagagcctgggagccagagcccttatgattaatatgatctgcttttccttcatggaggacaaagaaaaaatccactgccatctagtatctgtgaaacatgaggacagcgcagtcaagtctgtaactcttgccatgtcagaatccccaagttttgcctgcctggttgaatatgagagtccaggcatcagaaacagcagccttatttaatttaatttttctaatgactggcctatgacaccttgtgatgctaggcacatcctcatttccccatcctcacttgggactgagagcaggctcaagttccagggtccctggatggcaaggttcagtgctgggccctggaatctatggcacttgggggtctctgacctcagcctctgccacatgtttccaagttgagttgttttgctgaggtggtcctccccttgagttgcttatgccaaccctttaatttaggaaaagtaccttgtaattacttaaggtaatgtttaaatgttttccattcatttggaggtggtgccaacaggggggaaagcatgcagaaggctggaaacaatagctgagaccctactgtgggcccacagccctggcccagccggcactgaggggctggtgccatgttacttgatcacctggagcctgatgggacccaggaggtggcctgaggggatgaagtataacttccctcttctggatcccccctttcattttccttctaccccctctaggaatgggagttctagacctaggtctgcttttggctttcagtctgggttgatttccaagtcgaattcatgctttttcttggcccataggtccaattttggcagaaggcattggacttgtgccccctccctgcttcaagaggcagatctagccaggccaggctgaaacagctgaaacaggcaggccagtcctcctcagacaagaaaggggttttcagagggcagtggtgtgcccattccagacaccagtcttctggggaggtggtgccgtgtcatgggttctagtctggcctcttcctcagtcctcaggaggacccaagagactggcacggcccttctcctgcttggagggaaacccatctcccacttggtgggggcccttctcttgccatctgttggttagggtgcttgagctgagtggatggtgctgtgatatttttaaggagcctttcaggcaatgtttgcatgttagccagagggagaaaaagtgcccttttgggaggaaaatggtacgcccctccacttccatctggcactcccttcccccccaccccctcaagtggtatcaccctggaaatacctatgcaatccagtctccctaggagagagtgcatggaagcaggggtatgtgcagtgtagaatacagatgctacagcatatatgttgtatatatggacatatacagtacgtatacacacagagtaagagagtaaatcacgtctatatatctataaataatatcctatatatttatacatttctatgttttaaatagatataaaaatagagtctatagagctgggagagcagtgggaagcctggcgctgtgctgtgcaaaggggaagggagcacggccttcggagagggagccggggaaggccagcaggcagggttggctggcaagggggcctcctacccggagtgttggagaggagagtggctgggtcccggctcgctccatgcactttctctccttttccacaggcttggtctgaggttggaaggagataccccctgagctccagctgaggtgccccctacctctccccacccccacagcccacgcttaggcggtcactgctgcttggcagtaggacgtggtctctgactcctggtggagggaccactgcacaaactccttcaaaaccctcccccaccaggactgagcagcgtcagtggcaataggaaaggtccaaactggatcaagagctggtccaggaaagataccgcccctgccctgttagatgcttctgctgcccctagaggccaagcccctgaagtgcagccgtcctggcctccctcacttgctcaaccactgtcaggaggagaggatgtgggcagcatgagcatcgccaggcagcgctgcccaccatccacaggctttctggccagggcagggggcatcagctagcaggaaacggtgggagagacatatctgcacactcataaattcaatggctactccagtccagaagcagggctttggcccagcccgctccgcgcagcagctgctgctggctgtactcaggacaacgctgttccccctccctcacagaggccccgtggcccctaccccactcccgccgtaacaggcaggtttagttcacatacactgttcgcattctgtgacttgaggcagaggctgagctgggataccccaagctcatccactttcgttggggagggcccctccctgggtttatcaccagctcctagcccgggccgggcggggatgtctgggggccacgcgggggcactggtgcaagctggcagcatgacagagggcttgtgcagccctgacgggacccagaagcccatttgctcgcagtttcctctctctgtttttttcctcctggaggtaggagagagggcctgaccaggcaccagatgatggagcaagggcagctgcatgctccctctctccagaccagccttctgcttttggggtccgaaggggcatttgctcccatcctgagcctcctctgcccctgtcttgctcttccctaccatcctacaagtacctcagtctccagcaggcccacccctccacctgcagcccagggcgggtctgttctgccaatgcccacctccttgagccacagttagctgccaactgggtcttgggacaccctccagtacctggctcaagagagaccaggccgggccgagccttcttcccactgcagtggactagacccacggccaggggatgggcatccccaggtagcaatcccacaatgcactgtacctcagagagagagcacgccaggggcaccaagggaccgagccctctgtccagagggggacagcggtcacaatactgctcaccaaaagacaaaggccaggctgccctcgggcacctctcagtcttcacttttgtctctccggaagaaccagcagtctgattccgtctatttcagcccccgtctctctcttctccacccccacgctgctgaaccattttcatgtcaatcacaaaggaaaaataagtggggatggggggaaatacctaggagtctattatcacatacatattaatatgttaatactttctttaaaaaaaacctcttgatgttattattttgcagactacgctttatagtacctgtgtgacgggacctagaacactggatacaaatagagctatgttggtttatcataatatgtacgcagaaactttctttttgtcatattatccttgtaatgtaagaagattgttaataaaagcatttaaatttactcaccactgttgaattgctgcctccttgcctctatccccggcctgtgctctggttgactcagaacgggccccaccacaagggctcaggtgtcagaataggagcttgcctgctgccaggttggaaggaactagaagaggccactagccccttcttgctgctctcattgttcccccattagagtctctttccagcaagtaacctacgtgcctcgcccaccaggcaggccaaaagaggtgtgaccgaaaccgtttaaaataaatctctctgcccccatatgcattcatcccacaagaatctcctggaggcagcacacaagggctgtt

SEQ ID NO: 1599 - DNA, 2208 bp, Homo sapiens
gtcttgaggaccatctctcccggcagcataccgtgtggcttcacactgctctgcctctctgaacctcggtttcttcatctataaaatgggaataagagtaagccacctcaatggactgtgggaggcttaagtaaattgaagtgccatgcaagtagctagcatgcagttgcagctcaatgaatattatgatggccgcagatacgatggctacagctggggcacccatttcgggtcacaaggtagggttcaatgttgaagatggcagagccaattgcatccctgatgatcgtggagtgccgggcctgcctgagatgctcacctctcttcctttaccagagagagaaagacagaatgaccgagaacatgaaggagtgcttggcccagaccaatgcagccgtgggggatatggtgacggtggtgaatccgagccaggagtatggccagccctgctctaggagaccggactcctcggccatggaagttgagcccaagaaactgaaagggaagcgcgacctcatcgtgcccaaaagcttccagcaagtggacttctggttttgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccgaagccaactggatgaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggagagaagaggttgcagagggagaagtctgagcaggttctggataacccagaagacctgaggggtcccattcatctctctgtgctgagacagggcaaaagtccctacaagcgtggcttcgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcaggtaagttggtttggatgagattattgtcggagggcagagtacgcagtgggctgtgtggagggtagcctaaagctctctgtggaaaccaccttccgggagacctgaggagtgtaacgtggaggcggctacctccgtgggtgggagcccaggtcctcagtgtctctggcagacccatcggcagctctgccaggtgctccatgtgttgcccttgtatcctccttgtcaataaaggaagttccgctgcagaaggggtgtgtgctgtgttcttgacccgttgcctttctctggtactggtgtcttaccccaaagcccaatttctaaacccagtctttctctgtccccagtctcaagcagggtgtcccactggagagatctcttggcttccctaacttagtccaggaacacagccttgttcttctcttcctgaatctctgtcctgccacacatggtcccagttccctagcctggagttctagaaggatggagagtgaggggatccaggccattca

SEQ ID NO: 1600 - DNA, 1515 bp, Homo sapiens
atgttgaagatggcagagccaattgcatccctgatgatcgtggagtgccgggcctgcctgagatgctcacctctcttcctttaccagagagagaaagacagaatgaccgagaacatgaaggagtgcttggcccagaccaatgcagccgtgggggatatggtgacggtggtgaatccgagccaggagtatggccagccctgctctaggagaccggactcctcggccatggaagttgagcccaagaaactgaaagggaagcgcgacctcatcgtgcccaaaagcttccagcaagtggacttctggttttgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccgaagccaactggatgaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggagagaagaggttgcagagggagaagtctgagcaggttctggataacccagaagacctgaggggtcccattcatctctctgtgctgagacagggcaaaagtccctacaagcgtggcttcgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcaggtaagttggtttggatgagattattgtcggagggcagagtacgcagtgggctgtgtggagggtag

SEQ ID NO: 1601 - DNA, 93483 bp, Mus musculus
ttgaactcctgtctctatgtacccagctgcttgtgaataaactctatttttccgaagcttgttatcttagggtttcaattgatgtaacaaaataccgtgaccaaaaggcaagctagagctagagaggaaaaggtttatttggcttagacttccatactgtagtctgttattgaaagtcattgaaggaagccaggacaggcactcaagcagggtaggaacccatggagggggctgcttactggcttgctcaccacccccctcctctttcttttctttttttctttttttggtgttttgagacagggtttctctgtgtcatcctggctgtcctgcagtttgctctgtagactagactggcctcaaactcagagagatctgcctgtctctgcctcctgagtgctgggattaaaggtgcgtgccaccacagcccgacttctcagccttttttcttacagaacctaggaccaccagctgggtgtgagcactcacaatgggctggcccctccttggggcctcacccatcaatcactaattaagaaaatgttctacaggctagcccacagcctgatcttagggaggcatttttctcaaccgaggtttcctcctctcagatgactgcagcttgtgtcaagttgacagaaatctggacagcgcacttgtcgtcccagggatggatgcttggcgcaatggttttgtgaaacaggcctggtggggttgcagaagacagctctcctagcctagagctccggtctctcacctactttcctttgaccgcagaccctgtgacagtgctggagagagtgaatgtccgttcaggcttggagacgctgggttaaggaaaataagcagaccctgagcccatggacagcacccaggtgcttcagaggcttctggaagcttccacagctgcttccggttccttctccttccaccacccccctcctgccctggcttcttctgggacattccatctttcttcaatagcacatcaaaacctggtgccctcctggatactcattttgccaatgcgctcaggcatcctactgggactgcacctggggaagtgaggggaggacggaaggaagtactccccctcttctttgaactatgctttttgatattgttcactgctatgtcctacatggcaaagatggtttccctccaagggaagggcttcctgggctgtagtcaagatgcaaacagtaactactgccgggtgtgctgccatgacaggtgtgctgccatgtgggtgtgctgccatgcaggtgtgctgccatgtgggtgtgctgccatgtggttgtgctgccatgtgggtgtgctgccagggatggagacggactggcctcagctggtgatcctcctttgaggtttcacgtgagctcagccaggtggaggtgcgtccattgcacgtgaatgcgcacacatgactagtgaaaagagtacaggctccatgggcattactctctttctttggggtcttagcacaagacagcttcagactcccagatgcatgagggtggaaagtgaaacattccatttctccactccacacgagtgtggcccccttttctgacaatgagtttgattggctgggtttagagagtttccatttctctctgctctgaatcaaattgtgaggactcttttgcttgaatccaaaaatgaaatgaagggcatcccgcacaaataactttccttaattgttgtttttttttcctagatgacagctgatggagaaacatcgcagtatgaaaatacatatggtacttgtacacacacacacacacacacacacacacagagacacacatacacagacacacacacagacagacagacagacacagacacacacacacacacagacacaccacacctctgttgtatatagccactcagattctttccccctgctgaaaatcacttgacttcctgcagaagaactttctctcacatctgcttctagtggccagtgtatccagggtggttgagccctactttgtaagccaagagcctgaaacatttcttttctgaagtcagtccttcagattccatagggcaaaggacaaactaaaagcatgatgtaggcatttcttttttgtttgtttgtttgcttttcgagacagggtttctctgtgtagccctggctgtcctggaactcactttgtagaccaggctggcctcgaactcagaaatccgcctgcctctgcctcccaagtgctgggattaaaggcgtgtgccaccacaccccgtgatgtaggcatttctataattatttgtaacataaccacttaaaagcaaaaccattttgttgttgtcattctctctctctctctctctctctctctctctctctgtgtgtgtgtgtgtgtgtgtgtgtgtgtgtgcacatgtttgtgtgtatgtgtgccatgcatgcacatgccacagcctgcttgtggcagtcagaggaatattttcaggaattgattttctccctccctcttgggctccatcccgggctcgcacggcaaacactttcaccactggcccatctcctcggccccataagaacgatttctaatgtgtgatcacagtctggccagacttggagcctatacttgtcttttgttgtttcttgccatcaaccaagacagtccctgaggcatcttctggtagatcctgcttcttaccataagtgacagaggtttatggggtggggaacaactttgtctacatttttaaaatgaccacgcgtgcaatggggtagaagggtggagttaaagttcgtctctcttataccaggcccaagcttgtgtgggtcatgcttactttccaagcttgtttctaatcctccttcacagcctctctattcattcagcacaggtcttttcccctgaaggtaattagagctggtttcttccgctgcctcccagagtgacttgactgatgactgatgatgtacatcatagaagatccacgtgtccatcccagtggctcatttgagtgtgctttcagggacacacaaccccagcccatctcagaatcctggatttctacacctcctttccatggaacagttgtggtggtcccaggtcctgagaccctctccagtttggcctgggaatgctcaagtgtttgagtgggccctccttactggcacccttcttcttggggtagaatgacatcagtgcagtagtcaccatgggctcagcctgactgagtaataagaggatctgtttgtgcaattgtctctgcaatgtgcaacacagaatatggcagagactcaagtcaactttgtttggaggaaagggacagcattggctcctgtcactgaagaaggcacgagtgggagtgagcagggacacggctccagcagggacagctgctccagcttctgtctcagtttagctcaggtgacatgctgctacccaatgcctggagctgtcaacctctacctgctcccagtgcaggatcttcattgtcattgggttattggtccatctctgggatgagagcctgcctctgaggtccgctctcagggacacccgtctcaaatacggttcccgaggagcagaactgaagcgtgtttattcaggatcttgcagttggaacattctttgttgactaaaaaggacatagacggaaataaaaatggcattaattctatgccttcttcattgggtctaggtgtcattcatacagctctccatcaggaagctcctagctgctgggttaaaggaaatatgtgtgagctctaggaggtcaagcagtgactttaagatgtctgtctgcatagtccctgtgagttgggccagcagggttcatctaactgtcctcctggggaagtgttctgagatcctaggaacaggtgaagtaccagaaatggtttcaagtgggactgggctagctcactttggggatgagcactgaacgtacattctaaacagacgcccaggtaacacagtaagagctcactgtgtaggcttgcaggtatctgcagagatcctgagaaatgtgggtctgtaaacctgactgaggcggtgagggaatgaagaatggacagagaaatgagagacacgtggatatagaaaagctagggtcaggtgggtcgtgtgcaccctggtggagcggcaccagcttctgtaacaatggggaacctcagtcatttattatgtatggcagggttagctagtattaggtggagctcagtctcagcctgtgaacaggaggaggaagtcatagttgctgtgttcatgcacactggccaatggctagtggatacgagtgaaaggacagaaggagcctttgcctttccaaacctgactcagggaaaagggttggctactacttcccccatgacattgctgtctcatgtaaaatcatgcatgttcattcagagctctcctccctccctacaggtgtccgtgggaagaaacagagagacctagggggaagacagactaggcagagaagagaggagccggcacaggacgctgctggagttctctcaggagggcctgttggaggactgatctcaccccgctgagcggttgctctgtggatctttctggaagtcagttgctaaatgtgggctgctaggtggaggtgggagaacgaagagagcgaccttccagatagtccctgtctgttgagggtgactttactgtacctggtgggatcccaacaggaggatgggtgggtcacattaaagaaggtcttaccgtgggctcagtgaagagatggctcagtggttgggagtacttgccgctcttgcagaggacgtgggttcaattcctggcactcacaaggtggcttacaactgtctgtaactccagttccaggggatccaaggcacttttctggctttcaggaacgacaggtccacacacatgtatgcaggcaaacacttagatacataaaatcatttttaaaacgtctcaccaggccaagtgtggaggccaaagtccttaatccccatactcaagaggcagaagcaggaggatctctgtgaacttgaggccagcctgatctacctagagcgttcaggccagccagggctacattatgtctatccaaaacaaaacaaaaccactctagaactaggtgtgtggagatggccacgggaggaatggaagccgagccccagttgctttgagactgtacttttcgccttctcccattagacttattcttcttgtctgtgttgggggtggcgttcagccttgcttagctttaggtggctttgcccatctcacagttaggccctctattccagaagaaagctgcctgtctcagcaggcatgagctgggccaaagctgccacgtgggctcgggtaagccacaggcctgtgtatctctgacaacagggagtgaagctaaaaatggcgagtcttgtctttctagagaagtctgactcccactctgttcacttcttgccttgaaggcaacggtgcgcagaagttttgcttttaaccacaatccacaagaactgacccagcaagcacacatatacccccattctcaccttgatagctgtctgacatcctttccctggagaggaccttcctattattttctgtcttgtttatttgtttggtttaaagggtctggttatgcctctacacatgaatttctctgcccattgtaaagtcactgctgtaaggcaacatggagtgggggttgcccttcttatgcccaggaagctctcctagcatctcaggctgcttgaggacaaggctgcaagatgttggcagaagacagtggctgcagcttagcagccaccaggctctcgtttttaaaatgtgaatctttctcttctcaccgccatctcccattcaaacaagaaactgtggcctccttatcagttcctgccttccttggaggtagtacttctcagtgcccaggccccataggcagcccttcagcctagctggctctggtgcacacccacccaatccactccaggtgtgtctaatcttccctttccacacagtcagtattggggagcctgctaagctgacgtttgtagtccttgctgagggactgctaagggggccatgtttgcttttcttgctcaatggtcaggctgtgtgaaggaagagcactgttggctactggtcctgacaatctgatctacttcccaaaaacttaaactggacacacaaaaatagtctgtgctgggtgttagaattgaggcttgaggatcgaacctatataaaatgcagtcacatggtaaactcaagcttggctgggaacagagcagggaagcagcagggcagaagccaggtggccatagacagcgctgcatagcctgcaaggagagcagttgttaaggcatttatggactatggctgtgtctagatgctgtggacagaacctgatttgacacggacaggctcctgttcctagtctgtcagaggctcagcaaaggctattagcctgagtcacagatggcctaaggactcagctccccttcaggacttggtcctgttgagggtcctatatttagccagtcatcacaaaactttgtcccacaagccatcaacaagagatatcgctcctcaccaagagggacagatgcccagagctattcacagtcacatgggtttcaggatctcatctggggacaccagggcagaattcttccacatcaacacccagaccactccattgtttctgtgtgtgcacagaccagcaggatagggtggtggtttaaaaaccaaagcctggagagagggctcagaagttaagagcactgtctgctcttccagaggtcctcagttcaagtcccagcaaccacatggtggctcacaaacatctataatgagatctggtgccctcttctggccttaaggcatatgtgcaggcagaatgctgtaaacttaataaatcttaaaacaaaacaaaacaccaaaggccattccctcagaccagtccttaacacccataaaacagctaactcaccagaaccttcattttttgtccatttatttagaaaaaaattaacatgagcaaatgagatacctcagtgttacaacagagtatagaaatgtctagcaataatcaaataatttgatctttaaatacaaaataaccacatgaacacctaatatacaggtttcatctgaatacatatttattagataaatattagaggtcacatcatctaactgcatacagctttgcaagactagaaatcacaattagttttttttttctgaccagtcaaaagtatgaaatgattgcagtgtacatacgatgtacaaagacaagggcgggttctgtggacgtcacttcaggctgcacgtgtgggtgtggatgtgtgtacgtgtgaatcacctgtgatcatgatatcaaaaacttatacaaagtatatgaatttggttacaattttcttctgaaatccccgtttctcttcattgtttccatagcaccctaaaaatacacaggtggcagggccaggacacagaaggtaaatagtacatgtaggtaaaaataaaaacaaaagggaacaaaaacgcctctgcacacagggtcagtatattacaggagacaaggacggagtcacgaaggctaacaaacgggatctagtattccacgtagaatgaaggagttccaagccttttgttgtttctctgttttgtaaaataaaaacaatacacattccgggagaaatgaatgtatcttgttgacatgtctatttctcatttacatatgtacacacggcccttgagtcgctgctgctctctgcctcgtctggattggtcaggcccgagggcccatggggagcagacctgtagctctctgggatttagggcttccgttagggagaaagtgttaggaatcttttaaaaaataaaatggctacaggatacgtgagacatgaataaagcttcaaaccaagaagatgagggtgatcgcctgtgcggggggcggggcctttcccatctgcgcatgctctctcccagcccagccgcttagctgagtggcggctggtacgtgcctatgggtgggttgctcgttgtggtaaagtggcttgctgagacctcatttcggaggttactatggctccaagttgttgtaagaaaggactgaggatctttccagagcctaggcctgcctctgtttatggatgtcacctttacctgcgtctgtcactaccaaggcatggctccagcccccgatgtctttgtagctctctcaaaccctggatcggctccaacatttctctggaaggagacatttccggagtgtgggcttcaggctctgtggtgaacttgctggtgggcacttgcctgggagggagccttaggaaatcagcctcaggtgtagcctcgggtgtgaacggagagatgaccagagaggctgggctactgggaagtgtctaggccttttgcactggaaagctgtggagaacctgggcatgccttgacaggaactagcagggaccccaggctgttctggggcacagtatcacggcaagaagcaggaacttgtgagaaaggcatttgtcagtctgaagctgaacaatccgtacagtccgacagagcacggccctgtgccgggccaccgacactgggtagggatagccacggggtacctggtgtaatgtccctaccagctgactgagagtggttctcaacagtgggttgcctggtctctcaactcgagcacagccgcctcttctgctcctctctcatctgtacaaatagccctggttggtttttgtttgtttttgttgtttgtttttgtttttttaaaaaaggactcgggttttgtcactgagtcaagatattttaaaaacaccagcaaaggctataaccaggtcatgaaaatgttgaatattatcaaagacaatactaaaatattcacaaagatatttacaaaagcgattcttaaaataattgatttgcatactgaacacactgcttgaaaaaaccttaacaacaggacaaaggaagaggaggggtggggaggtggcagctttccttgtgcctttttttttttagggtgacaataagtcaacagctaggggtcacctttctggttcaatctatattaagagtgccagggagcacagagggaggctaatgaccgatgacaaatgaggacgctggcagtggacaggaggcaggagaaggccttgggtggcagcatcggagaagggagcaaagaatttacagatgggactcatgtgagcggacaacctggcatcaccacaggcatcaccgtaggccatgaggctcagggggacacagaccagcctggcacaaagcaggcgagtgacaagccagcaggggactctaagctggatggagtgaaaaagcagaggagggccagaggctgcacttgctgggtgagcaggagtgtggagcgagctctggatggagggagaaatacagggagtgacaggccataaatgccacaaaatgcctgcctgctgagatgctctggtgcacccagcaaaggtctgggctggagacaggcagctttgagcagagaacctgctggaccagactgagagacttggagatccatgaaggccctgctgtggagtcgtttccctgggggcctatgctgcttccctaccatgtgcccctacagctgtctggggaaaggagaacccagagggaagtgggtcccatggaatagtctcagagaaggaagtatgggtaggaggaaggaaagagaacatggggggaaatggcttgcttgctgtccagatacaatgttcctttccttcagagctccttcttcagagctccccgctgcgggtcatttaaaagcagggattggcttggggcaaagctgcaaggccctggctgcttctgtggggctctggctggcatcgtcctctggcctctaactaacggagggctccctttggtgtggtgcacacactctctgctccccgcaaggcatggccctggtctgagttaaggagccctcctctgcattgtcttggctctggggaaggccctgacctgtttcctgccagtccctacaaggtgtggcactctctctcagacacggcactttgtccttgttctgctgagagagtgtttacagggcatcttggcttagaagtcagaggccaaagccacgacccccggccttgagggatggtctcctccccagagggttgtgcttttctgtggtgtgtgtgtgtgtgtgtgcgtgtccttcctcactgctgcaaactgtcaccactcctccaaggcttgtccactaccctggcctgggggccggagcacaggcttctttcgggttccagtcatctgaaggaggctctgggccaagaggcggggataaggtttaaaaacatggaagaactttgggacactggaaggtcggttgtctggagtcagcacacatggagggacctacagtcgccattggcatgtctcttgctgggcctggattccctcagcttgggtttgtcttccaggggccgtcttcaggcttgctctaggcatagatcccagagcattcaggcaaacaggactggagacccacatggctttccctgcctagtgtgctctgctcagctctcagcctgaggtcctggtgtgggaggcctgagcatgggctcctgggaggaataggatgtgggacagatggggtaggaggcagagtggggagggatggccccagtggagagtggccttcagttgttctcaaagagagacaggaggtcatcgttgctattgcttggaaggtcgggggggtccaggtaggaaagaagctcatccgggtttgtgagttccggcagtagctagaaaagaagaagcctcgttgaggtgtctgaggctgctccaggaggagtgagggctctctctggccttctcactcccttccgcttgcctcctggagttctacctcaaagacagaaaacttaacagtgtcaagtatgggcctgccggctgtccccaagaccactgcatctcagctgggggcaggcatacccacactcaacaaatgccaaggccggggagacccactgggctgacccctcctctcaatgtcagccccatggcagatcaagggctggattccttttgattgctcctctgtcctctcagaccctgccaagagcatctttgggtcacacagcctgctggtataagccctcggttttcatccatgaccacaaggcaggccgtgggaagaccagatggtccccacagtgcccgagactactctcctgtaatcttaagtgaactagtggctggccatactgtcctgtccctgtgctcccctgtccccactccccgtgtgacacccttgaagtatgtatgtcacacaggggcagaggagctcctgaatctagaagcatccctcagtctggctaaggaaggagagttgggtgagaaaccaagacatctgcaaactttagacagcactgcagttctccctgccaagagctctttgatgccaccgtggtgggtgttgatagcagggccaggagttcagtacctagggatgggggctggctacagcttccagcccctggcgggggtaggagaggaaagtgtccagtcccaatctttctgtgatgcccaccaccccgccttctatactcctgaggtcttggaatgggagatgcttgagtctcagctgcctagtttgaccctgtctccctcgagtcatgtcctccccacatcatcttctgtcatccgacatggagacttcttggagtgagcaatggagcaagcggaagcagggaatggagacacacggacagggaaaccgcaagcagacaagaccagcaagacgatggtgggtggggtgtcattcttagctcttcccctgcccaggccagaaggtagatacagaaatagcaagcttgacatgggggtgtgagggaggggatgggaagaagggcaaggaccctcttgcactatctccaaggctctgactggagggattggtcaagggcttacgtagaaggtgggtaggaatgaggaacagggctatcgggccaaagggctgatgggtaggggtggggcttgcatgacacacccccatatggggcttcctagtgctagagtcaggggagactggctggggcccatccaccacccacccacctttccacccggggccttgagcccttaagtaccccccttcttttgggaaggtcacggtgccgagcctggccccagaccaaggtgtgtggtgaccccaacttacatccagtgaaggttccggcatgtcggatgctccctgtgctccggcctgaccctctaaggctgaggaggggttaaaggtcaggtcgctgtgtggatggttgccgggagcggcctgtggtggctgccggggaggctgggaaggaggaggagccccactgtgatgtaatggaggccctgcctggctgctggggtgtggtacgtgcaaaccttgttgtatggagggatggggctggtcagaactgccagcgtggggcatctgtggaggaggagagagcaggagaaaagagaggtgaggtgacggaggcacaacgacgggatgcctggagaaaatgaaaaccgaacaaaccaggaagtaacggaccccaaaacgagggcacccctcaacagagaacaatgatccgccgttgagggacggggtagaaaaaaaacaaacaaatcgtcctctccagaaaccaacaaccaggaaggctgtgaagggacaagtggagaaggccttcacaaagcctaggaagggcctcgagccagcacaggccagagagcctcccacccccacactgtcacaacaaacaacagcgaggccagaatggacaagcaaatggacgtgtttctgggaagcggtagctgctggcagcgtggtgcagggccctcccccgaggaccagggcagtgcagagcaggcgtggacacagcacgggcaggcgtgcagctccccctggctggcagtaaagaggagacaggtgctcagcccgcttccctctgggatgaaactcatctgcagtcaaaatggcggaccagggagaaaacctggctggccaggggcatttcagggtactgccttctccttgattagaaatgggcttcatggtgggggtggcaaggaacatggagggacaactctaaaggttagctagggaattccatccttttaacttactccatgctgttgtgggtaggtgggtgtaaggggatcttatgtaagtatgtgcctggtgaatgctgtttgctggtctcagcagacccttcaaagcagaaagcctgaagcggctctgtacatgtccagcaaaggcctcagcctgctctatacatttgcacagggccaccagcaccctcttacatactgccaagaaactatcattttggtgacagaatgcttccttggtctcggatgatttccatctctgccccatctccatttctgggttctcccatgccgggttggcgagtagcgatcacgccagccttgatctcccagaccctagttcctctttccatttctgctaaaagctgttccccaagtctgctttgatctggtctctaccaaaagtcctggtgtgccctttctttgcagggtgcagggctccagtgtgacaccagtattacagtattcttccagtgaccctcatgtggcatggtataaagtggctggaagacaaggccacatagtggtaagaggccagctgagggtacccacttagctcacaacagcagatgtcccatgacacccacccagaggaaacagggagggactccacactctcatgaccagcttagctcaggacagacatctcggatcctatgatatagcttctcccctagacctcaacaagagtgtctcagagccagaagtactgctgttgtgtctgccaatctgctgcctagtgcggggagaactcttgggcaaaccagcgcttggttagaaccttctagagaatcctggactacacaaaaaaccctccagccatctgcccagccagggccagctgcttctagatacaacaaggtagatacaccaagaatagacctggggttgtctccccatgtgatacaatgcgtagctaggcctggttgctttcagtgagatgaaagctgagaaagtaggcacgcctttgtggaattctgggggggagatatgagcttgattcaggtagaagatgaaccaggaagcaaatagcttggctggtaagagagcaaatggctttctctatgtggcatctttcaggatttgtgagtatgaggacttggggtatacagtgtgtgaggggtgatgtcggtgacatcagctgtgttaggccgaggtcctggtgagcttagaggaggagagcagtggctccaagttgagaacttcaaagtcagagtctatatgtacttttctttctcttcctgtcatgttttctttgaggtaggttctcaagcatcgcaaggctgaccttaaacttgctatgtagccagggaatgactctgactttggacactccttccttcacctctgagttttgagatcacacgtgtgtaccctgtcctgtttgcttaggcagctctgcagaagccccctacccaagggagctgtgtcgccaggcattgtactcattcttggtgggaaatcggggatgtaagagaagatgagaagcctccaaccccattactaggcactgaggaaactctggaccttttctggctggtcttcttatctgtgccccttccctccaaggtgagagaccgacatgaatctcagtgtcccaacccccactgctcttcttccatctcggctcggtgtgctttgtgagcacaaggcccgatgtgcccattcatcccgacccaaggggcatttgctatgctacacagagcataacagttgagcattcaaacacagaagggctcaagaggatggccaggtctcttgccactgtttgctgagccacaggaagggacagatagtggttaattctggacatcttactccacagaggtgtccccagtcttgtgggacatgccaataagtgggagacaaggaggacaaacaagccctcaggtaggccagatatcctgggaccgcctttttacaggtggtggtggtgagaccctggtgaagattcagatacccagagactaagtgcctgggagtgggagctaatttcaggaggccagaaacacaggcatcagtggcagagcatagttggagctcaaggtgggcacatgttgatgcagggggcagcctggagctttcttaacttaagagactccaatgcccccaataaaacagccaagttgacaggtatagagcaaccctgtcagcctctccccatctgagcccctgagtctaattcttagtttttcttttcactgaggagggaaccagaggactcacaccacaaagaacccgagggaaagccctctgccccagtcagccagatgaggctggtaggcagcatgggcaaatgggaaggttgaggtacaagctgaaggtactcacagtttcctgcatggggtgactgaggggtttctcgagggcggccatgttgttgggcatgtccggtgggtgcgagagctgggggggaccgtgcatgaagtcgttcatggatgtccctccgggattcccatgggggaagtcaaagttgccatgaccctggtagttgtttcctgggatgggaataagatggggatgggaagaggtcaaccagtgggaaggtggccaccctcagctgatagtataaatgcccaaaggctttccgtcccttgggacaggcaaggctcctgaagcatttgctttgggctacaggatggggcagtcatgcccttatctcatggactggggcactccaggtgtgtgctaaagtcaagtccccaaccccactccagatgtgtgtgtgctctactgttgcagaagggcagaaaggggtctagccaccaggctctagatgataacccagcctctccatctcacacctgatggtgatgatgagacagggagactcagagtgctgggatgccggggcccttggcaaaggctgtgggattccagccagtaaactaatgactctggtccactaatcagtcacctgggcaccttggagacctaaggccatggatctgagtgacaaggccaccaccctcagatagaaggtacacgtgcattttctaggaacagagtggaaagcagcagggatgatgcctgaagtctgggatagcggagagtgagaccaagggataacagactgggttagccaaggctgggccgccagtgcctaggtgttctctgttagagggtgggagagcctaaagggtggaaccgataatctggcagagcaggctgtgcaacctctgagcttccatcatcattctcccaagtccagtgaccgcagggatgtttttgggggtgtgtgttcactctttctcttttatttttaagattgactttttctgtgtatgaggggaatccgttgtccacgtgtatatatgtggttccacgtgtgtgcctgcttcagggggaggttagaagagagcactggatcaccttgaactggagctatggttggttgtgagtcataatggaggttctgggaattgaacctacgcccttctgcaagagcaacaagtgctcttaatgagcgaaccatttctcctgcctcactcagccttttgtttcctcatctgtacccgttatcatcagcacagagatcccaagtccccgatggacccgggattgtacccttcttcctccctccctccttccctggccagcatcacgttacacaccttggctgctgtagtcgttggagctggtgcccccaggaggaggtgggagggggtagggagacgggccagggcccagagcggcgatcatctccatgacattgggcatgatcatctggctggggctcatggttttgaaccgctttgaggggatgccatcggggtcatccttgatgtggaggtctgacttgatgggtactggccgccagctgcacgtggggtcaatggtgacctcttcaaactcggagctgatgggggagagcgagggggaggagctgaggtttagaatgtctagccaatgtcttcactcctcccctgtgccagaactgtgcatgggaccatcttgtttgatgaggtgagaatattgaggcttagaaagacaagtggttgagcctggggctgctggccccaagacaccttccccgccaccctagaggagttccagcacggctgcgttctgtctcatctaagacatattggcccccaagtccgggtattcccaaggtcaagctccagatgggtggctgcccagcaaagtactcaggactgtctatgtctccctccagccaggctgcacctccctagtcgaggccacacttactgttggatggcgttcaggatcccccacatgtactgatccacttccagaccctcgagcagagcagttttactggaagagaagaacagaggcttggtctttgcgcctggaggcaggacacagcccgcccacctccactgtcctgccactgtggatacaatggaggcacagagtgcaatatagcagtgaaatccaaggcccatgcctctgtggggctggttttgcctgaagggtaggtaaagcagctaagaggcccaagaagaggccagagggcacctctgctctgcaaggtgggtattgcttacttgcacacgggacacctccaggtccctcgctcacaattcagttggaggtatgactccaggtcaaagcactgcagaagtgagagacagagagataggtaagatcaggactgtcagaaaatgccttgctgtggctctggactcttgggaagacttcagtgctggggaagaactcttctcttactccatagaaccacagaacagccatgctgtgtctgccacggccctcacagatctcttccctgtcctcgagtaagcccttctggacccaacaccccagccaagtctcactgcttttgcctcttactgaggccgggaccagtgtggactctggcagtccccttaatccatcccagggacccagggtaactctgttgatcagcctgtatcagacaaagcaatcacatcatgtccgtacctacaaactcagagggaggcagtcctgtctgccacttagctttcaggatgaactaactgtgcttcacagtgtggcgatgatggtgtaattggctctgccatccttgcacccctgtcgtgggaccctgtcttggccaacccctacacaaccggtctttgctagtctaggttgcctctttcttgaacctgtggtgtctagccaggactttctgctggcctacgatacctgattgtctatttctgcattactacccctccccagggcctcagagatggacctgaaggagaaaacaagactgagagagcacgagatactggctgccgatggccgcaatgtctctcaggcagcaacaggctctgttggcccttggcctgccccttgtcaccctgctaactctgtacagcctgggcctgctcacctgcacatgcttgcaatcgtggcctcgagcaggcagctgtatgcgccggaatgtgatggggcacttcagagacaccttgatggcggtctgctccacgccatcctccccattgagagttgtgttgcccgaggaggcagccacactgctgaaattccgcttgactgtgagtgaggaggcagagggtgagggctgggtgctccactgaggaaattggatctcagcagctcctaaacacggcttggattccccacccctgcatcccacatgccacacatgccatgtgcaggtgagagagaaaggactaaggaggatcccttttctgaagaacaaaccctacccctgggagcaagaactttctgccaagcttgcagaaacttagtctggtgctgctcctgatttaactgggtcagcaaaaagcccccttaggcgcttttgcacctaactgcaagagtaggaatagaaaccagactgtgtggaggtgttcaggggctggggggggggggggggaggggaaatgtcctaaccccagcaaagattcaaaaaggagtggccttgtcatcactagtagcaagaatagccaccaatctcagaagtcccaggtccgctgctgggcctcacacccacaagctaggtgtctggaattcatgcgtataatcctgtagccttcctcctggtactgggtacatcccagagtcagctaatgagttctctctgactgctccctgcttctcctccacagttaccctgggggtcctagtgccccagcaggcatgggcatccctccacatactcggcctcctgctgacttcacccatccagcggccgctgctgcagcagctgcagagcagctggcctccctgaattgtgattctagtccatattccttgaccctgtttggggccccttttctcctcactgtctttggttttctgtagtgcccatgcttgtccttggtcacacattgaagcagtggactctaggtcccgagcgtatctacgcctcagcagatggccactcccccacccgtggacccctaaaaccttgcagaggtgctggggtgggaaggtaagggatgtgtaagcctgctgatgcctgctgagggtcagctggactttctaagccctcaccctgttgacgctcccttggctgtagctgctgtagctgcttccggaggagaaggtgttgttctgtccattaaactgttctggctgttgaaatgaaatgagacagaggagtaagcagagcagccccgcggcctgactccgctggagacacgagggttctggggaagaaggcaccaagacgggggtctctaggactagtgtggaaagtggaggggcccgagctttgctcctgttaacaatttagtagacattttccacagcagcgatggggattgctgaaatgaacacccttgagcaaagatggcaaacacgctgaagggtaaactcaagacgggttttcccttctgagaatgcattttgcagcaatggaaaaggttaaaggctcagagatcttcatcaaagcagcattgtaaaatcgaaaaatgaggagtgaatatgggaaggatgagctagggtgagatcatcacctccatgggctgctgggcagccattgagacagggacagagacattctataagcaacaagcatacaacatgtgcagggggaacaggctcaagattacagtggtggtcagctttgtctttcagaattgtgcctcctctgccatcattgtctcatgtactgtgaatgaaggagaggaaggctattctgagcccagacacagttgagcactgacagaaagtcaggactgcaccccccactcctaaagctgttacaggtgtgttagttatgtgggtaccctgaagatggaactcaccttgtaatactgccccatgttgactgtggggggtgggtactgtccggtgctgggttggctcggcatcctttgtccagggtagttgggagatgtgagtggccttggggggttaggggtagggtactggcctggctgggtggggaactggctgtttggtccatattgctggtttccatagttgggctgtaggaatggagaaagggcaggggttgtcatggtgatgtgatgtactcagattccaggtctggggcccagctttttttttttttttttttaaagactgattttatggcccatatatattatctgtatgtgcactgtgtgcatgcctagtgcctgtgaaggtcagaggaatgtaccagaatcctggaatcaagagttatggatgattatgagccatcatatggatcctgggaactgatcctggctcctctgcaagagcaataaccaccgagccacctctccagctccccaacttctcttcttagctctatggtctcatgcacacaagacgccctctctacctgtcatagggagagaatgagccagagaatattaaaagcctccacttgctttgacatccagggacactacatgctgcaggtccaggccatatgccatcactccataaaactgtttttttggaaccccacggatgctcagagcttctcagctgtgtctttgaggggttcaatcttaaagtactcctttgtttctcccactgtttgcgtgtgcaccccgatatgtcagggagatgcaggtcacagaatttgttaccaagagctgacaagccatgcagtgaggctgatctggatagcactgtccctacatcctatacagagcaaacatctatctagtgctccattcttagcagcgtcaactatacagctgtgggagaactagccaatgaggagtggggagcacgagagcccctcctagagaagtcactgaggaaggagacagtgccacctccttccatcttccctagctggaacagtggatgatctagggcttcctgtcacctaggtacccagaacatggtgtcccagagtcaatggttctttgatgtctattcaagaatattccctgtcagagagtctcatcctctaggcttaaatctagttggtgagagtgcgccaagtgcctgagagtgctcatcagagtggactgtgctcaggaactttcaatgactgtacggtggggggacatctgctactctgggccacagcgagttctcacggtggtgtgaagtggctggtacctgcatgttcaccaggctacaggagtgtggtaggggaccagacaacatgattgaagcctgaattaaggatgtaccttttttgttgttttgttttgttgacacaagatttctctgtgtagctctggttatctcagaacttgctcggtagaccaggctagcctagaactcatagatctgtttgcctctgcctcccaagtactgagattaaaggcatataccaccaatgcctggctaggttgtaccacttctaacataggatgaacatactgccatgaggtagaagccagagctcccagcatcttataacctggaccagctgggaagcagcaatgctctggggagaactcctttagtaaaagcagagggcttggcttcaatgtagggctttcaatatgcaattcttctgcggcctcatctcaggtgagcagcctgaagctcagacatgcatgcccagtgcagccaactatctctcaggaggttgagggtagagggtgtttagtgactgtgttctgggagtgaagccatcagcttaaggccccaaaccaaggacaggcagggctgggaggagcctaaaggcctttgagtttctctccctagtgcccactaggtcgaggctcaggtcttgagttggcctcctgggtgtacaggaagcctaatcactatagcctattcctgagtctcaggcttagggcacctataccaattatgacatcatccaacctctgtgagagtggcggctgaagggacctgtggggacagagagcttatgctttcgtgggatagaaatctgcttcagctcaagttgaaggccacagtcttgaccagccagaaggacatgatctgagaagatgaagagctgaggtgccatgcccaggaaggggcatcatggtgtgccaaagacaaacttcactggagcgaggggggcgcatcagctgggcacggatcttggtctcagttgtattctgagtgtcactgagacctggtgacttcccttttcccctgaccttccacggtgcttgggaccgtctgctgggatggtttcctctggcacctctgctaggagaccccagagaaggcaccatccccaggagagcaatatgatggaagtaagccctagggatactgtgtgccatccgatggcctccctgacacacacagcctgtactagtgtactagtggcagccctcactctctaggtggctccctgcactgaggtcctcatccagggtcatccattagtatctgagtatggacagggttaagtggtctccatggtttctgcttctacacttgcctgctctaggcagggtattttacaatgtcacggccccctgtcctctgggcattctaagggccagtgtggattgtgaataccattgatttaaagtcatacacactcaggtgtagtgacttgtttggtgttttccacaacagagatgatattagtcaggggctaagcctccaaagccctttagttcaagttctctaagtggcctaactgtgccttttccaaggtccctgggtccatggtccctctgtcaatgttccttctcctcccatcccccatcatagtcacacttacctctcccgggtatggcctctttatgctctgaataggaagggactggggccgggggcctgggtaggtctgctggggcatcctttgcccgtgtgtgccaaaggggctgatgccgggtggtcggggctggttcatgcccatgggagggccgctcatgcccgagggtgtcatgccagctgccatgccggcagggttcaggctgccccccatggaggcaggcccccgaggcccgggttggttcatgaattggctgttatacgcctgggtgggacccatctggaaagaggaacacaccttcaacgggagaagaagaaaaaaaaaagaataaaatgccacatgcattgaaagtgcagggaaggaaggtagggggctaaagggagagcagcactttcccacagggctgcagttaagagccaggagctcttaaaggacccagtcctccagggctcactactgccctctgcaggtctcatgggaaaatgcagctggtgggtttgggtagggcagggagcagtcactccaaggcacaggcagcattcccagggaggcaggcaggggacatggaagtgggtagggatgggagggacacagggaggacacaggaagaggaggcggatgaggatggaggctgaagccctttcctgaaagccctggccttgcccttggtcagtagccaatggagacacaccctccatacactaagtgtgatttacccagcccacttcctcctgctcaccctgcacccttccacccacacacaacactcttttaaggggcttccaaggatacccgtggcattaacgctcaagatttccccagcctgggtgaggccaggccagcgggcaggaacccttaccggtccatactggtttatatccttgttctgtgtctcttgcaaggctgccactgtagctgtggctgtggctgtggctgtggcagcggcggctgctactgcagctgctgcagcagcggccgctggctgggtgaagtcagcaggaggccgagtatgtggagggatgcccatgcctgctggggcactaggacccccagggtaactgtggaggagaagcagggagcagtcagagagaactcattagctgactctgggatgtacccagtaccaggaggaaggctacaggattatacgcatgaattccagacacctagcttgtgggtgtgaggcccagtagcggacctgggacttctgaggttggtggctattcttgctactagtgatgacaaggccactcctttttgaatctttgctggggctaggacatttccatagcttctctgcttttccttggtcaccacagactaccttctaagcaaacattgacctgagaattgtatggtgctgtgtgctgtagatgtggattgaggtgtgtgagactcctgtgttgaactgcgaggctagaaacccagcaactttgccccgagagctaggtggagtgtgctcaaggtggcttgggctgcttctgtcccttcttcactgtgatctgaggttggggactctagcctccatttcttcttcattcaggtcagtgagctttctaaggagttttggacagatggagctcactgccactgctctccaatcctgcctgctcaccccactgtcttagcataaaggtacacggctgagaaggaactgaggaagtatcccctctacccctgggaggttgatgccaatctgctaagacacatggcagaactgtcctcatatcctagaccaggccatgtggaactggcattcaagtaagagtccttcctggatgtaggtaggaaggcagggctaacacaatgctgtagaagggcaccatctaggttggtcactcacctggccccaaagcccccgctaccagggtagccaggtcggccgtacatgttgggctggatatagggctgtgcagggccagctttggtggagaactgttgctgttgccctgcgaactgtggggagttgatgccggggttgctggtgctcatgcctgatgccatggggttgccacctggattcatagggttgttggcattggccatagggttcccgaggacctgcaaacagagagaaagagagagagagagagggggagagagagagagagagagagagactgtcattaaggtcggtacctgaggcagcgtggagaaagagaagacaaagactgaaacatggcagggaagacacagcagaggagcatgggagtggcttgaagagtccccagaacacgtaagggatcaaagggagtgggctgagaatgtcagccaggaaggagtgaggccaaggctcacaaagccagcccaagtggtccccatggctgcagagatagatctgaggcaagcgaagtctttggcaaacattagcctactcggtcccaactctacaatagggcttggtggacgccctgggctgctgctctaaaaaagacacctctgtgtctttggcccagatgttgtctgtggatgaagacccagggaagcatgacagctcccccccaggatggcctggcctaggtccggcagaggggggccctctgttaggaaggaggtgaggagagagaaaagaagaggaaacaagaatagcatgtctgggaagacagctgggcttgtcaggctaaggcaccctttactgagaggtgacatcttaggaaaacctaatccagaccattcagggccaaaggtttccagcttagaaccctgaggtcagtaacgcccagtaacgctcttgtttgcacaactggagggaacaaggtctcagaacagtactcatggccttgtcacataaacacccttcctcttctatcccagaaggccctacaatgggggatgatcctcagggacccagctgtgtccctactgagacagctgtgtaccctttccggagtgatgctgtctgcagctggatatgtcctgagactgtcttcagtgaggagagtgtcacggcacggttctctggagaacccccctccccactcttgggaggaataagagacacttgtgcctaggagggaccatggtagaggatgggacaagttcttacctgactctgggatgtgttggtcactccccacaccgtggtgaccacggagagggagccgggaggctgattggtgttctgctgccaagggacagagtcataaggaaatgacccatcactgcaaagagagaagaggtccttagagctggggcaaggcctaggtggcagtgtcttcacttcactatcccagccgacctttgccccagtgagctctggggctccaggctcatgacagcacttgtataatgggaatgggccaggcagatgtgaccctctcccaacaatgcaggggctacccctgtgttagctgtgtaagctgggtgggtctacagtccagcagctatgcagtgaagaagccagctagtgcgatcgaaagctcactctaagtcccttcttcaagtataccgatttcccatgaccccctatagaaacagtcaggacctcggcattgtcttcactggggacagcctggttccaactttaatgaggctggaagggccttggtggaatcttgcttctgtccttgttctcagcacctcatgacaaactagctgctgaactgagtcccactgacctggacttcggaattcaggcttgggtcacccttcctctgggcccaggaccaggcctgcccaggtgccccgccccacctcccagtcctgtgcacatccctgcctggctgaaaccttcccttccctacaagtcagcatcatcaggctccagggtttactgggtaaagtccagatgcactccagacagaacgatctatcccactggctcgtccctgagccttcaccaagcctcctcactccagccctgcagtgggctgctgatacagggagctcttcccaaggagccctcagggatctatctacctcctctactcagtaagtctcaggcttacagagaacactcagaaaggccttctagccagccagggtgatgtgggaggagcacaaggggtccagagtgatggacagcattgagacttgccagggtccctaggcccactctagatcacccttacttcctcagtgagagccgtaaaacactgtacctgtgccccagagcagcagaaaatctcgtgtggcaccctcttccctgggtctgcctccactggtctgtgctgacttgcttcctgtttctctggaaagtcgcctctttggaaagccttcccacctctcggaatataaaggagcaacccaccctgttctttacgtatttttcatgacacttatcacacatttgattattatcttcctagcctctactccagaacctggagtgagaggaatccagcagttttatgggacagagtggattaaaggccaggggacaaacaagctagccaggagccaggccctgaactggccccgagagtggagaagcactcctgaacaagccctgtattttctaagctggggtgactgaacactgtggcctgcgctctcattgttcatggtggtcagagagtaacctactatcttaagctgttctggcccctgctgcctggtcaggtatccgccgacctggaaattagtcctgaacccatccctcactagctgaccctgcaagtcttccttggggcactctcatttttgagcacatgccctcatgccttgtccaaatacaggagtgggtcctggtgctcagtagcatgagggagcagaacacagtgacaaacggggtcgtagcttggttgggagagtgcctgcctagcatgcacgaagcctatgctttgctctccatcactgcacagacacgcccggagagaaatatttacagttaccctattatctcagaggagaagacgggagaatcggaggttcaaggttatccttggctacatggaaagtttgggtctagcctgggctgtatgaagccccgtctcaaaaacaaaacaaaacaataaccctaaactctaaacccaaactaaacaacacaaaacacaggcgggagatggctcagtagttaagagcactgactgctcttccaaaggtcttgagttcaaatcccagtaaccacatggtggctcacaaccatctgtaatgagatctgatgccctcttctggggagtctgaagacagctacagtgtatttacatataataaataaatcttaaaaaaaaaaacaaccacagtgcagatgaataaatactgttctctcaacacaccggccactgtggactaagaatcagtaccaagaggctcagtcaagaacacaatgtgagcacaggccttggggtctgagcagcacattctccaagaggataagagtgaagcaggctcagtattcttggtgtccaaggagggggatatcagggctagactggagagagaaacggcatggctcaggagcagggcccaggagcacaggtggctgactgaggactaaatgcagcttgtgaaagtgaggcctgtggccaggcaagaagggaggggctgagccacagatggcataaagtacctggctgggacaccctgcagagcgtgttttcacagaaaagggagacctctggccatccattatccttctggattcccagctctggtatgctggacagaggttctcgagtgaccgatctcgagtgaccgaataaagcaaaaaagtctgtctttcccccaccacaccccacccttcagaactgctttacaaactccctaccaccttccaggctcgtgaagatttgattcaggttttaacaagcagctggacaggtccaggggggaggggggccccctgtctctcatcatcttggctcccaggctactgtatctaaggcccctactaccctcagcaccatggctgggccttgtgggaggaaaccaccttttcctgttctgcctaccactgacagagtacaaagctagccaacatttcccaagtgggctctccactgcctggccagtaggttccctgtctcagaacaaaggtggccatctacttagtgtgcacagggcccgggggctgctggacgcatgctggagaagcaagtgacaggcacaaggggggcggacccaggcctcacgacagaagtggcatccaccagcacactgtgactcatcgccttctaagggctctgactcgacaggcaaccacagcatcaggcctgtgatgtgtcacctctgcctggactctcacccctgtctctgcaaaccaaggacaaaccaagctcctgtgccagcagggaaaagggactggagtgggaggggactgagtggcaaaaggtgtcagggagaagggctctgggagatgcatgccaggcctttgggagaggcgtaagcactggccagtctcagtgatcagcactgttagtgacctgaggctcctcctctgagcttttcttattaattaattaactaattaattaaatggtgtgatggtgcttaagtttaatcccagcactcaggaggcagaggcaggtgaatttccagaggccaggttggtttacataatgagttccaggtcagccagagctacacagtaagaccctgtcttggaaaagggaattgtgtgtgcgtgtgtgtagaaacactaggccacagcacacatgcgtaggtcagaggacaacctgtgggagttggttctctccctccatgatgttggttccaggagatcaaacaaagtagttgtcaggtgcctttgtccactgggctacctcagtggccgtttttgctctcttgttaaaaataattttctggggtgggggcaagaagagcctactaccaacagagcctggtacagctgtgcaaaaaataacaactcatacaacttgtgtttttccttttgttttgagacacagcctcactatgtagcccaggttggtcttggatttttgaccctcctgcacacacctctcctgagtgggatacagcctgtatctttggtaccctttggtttcgctttctgtagtgttggcaatcgaacccagggccttgggtttgcaaaacaatactctaccactgccccacccccagcccctgcttgctctgaaggggctgggaagggaggaagagccggtcaagaggaaatcaggctagtgttgggaggccatacaagtccctggggatccccgtgcaccaggcttggttctactcttcttcccacagatgaggaaactgtgggtcagaaactggtgtccagtctcacggccccatgccatgccatgcctccacctagcattccggggcctcgctttagattgtagcaaatccctggccctggaggaggcaggagctcacccttgatctcagaggctccagcggctttgattgtaatcaaattaatagataaacaagatttattagactcttaattagctttgcgacaccgatttgcatagagacaatgtgctaatcacaaatggctttttaaaccactcattaaaaacctgggatgaggaaacagacgttgttgggataaagtccagatcacctcagggacactgaaggtgtccttctgcccaggcaatggctagatcctccaggtaacacacagcttctgtcctggagttacggtgggggtggggggatataggatgtttctgtggcttctgctaagtggaagatgaccttggtatggtcaacggtgaagctaagacagaagctgaggacttttacaagctacagttagctcatactcgtcacagggtcacagctactcttatcaagtgctttgggagcagcctggatcttctctgcatttctctcatggtggtgggcagcaccatgtctttttggaacctcaggagctcagagaggtcaagggctctggttagaggcacagcacagcctaaggtgaaagaacttgggccccaacttgtggcctcacccaactgtggcaccaccacatctacatggcttgcagagggtatgatagtgctctgaaccacagaaagaccatggtccccaggggccctcagacctctgggttcaggtagggtttccagctccagttgaggacccagagtctctaaatgcctggctcctctagggaccaaactccagacttcccagtgtacagaatacaccccatccttagtaaaaagacaacagccccttttgaagatatcagagttagtttctcagttgcaaatacttgctttttgcttccactatctatgtttaggaatttacattaggggtttaacaggtgctggggacctccagagttcccctggaaatgagagatttctcccacagggacatgcacgaaggttacaaggagccgccaatcaagtcaattcctggtcactggttactgagtatcctctccaccatcctgggtttggagaagggtcaacaattgctccatcataatgtggcaggattatgataattacctagggtaagccatggatcagagcagggcatagactgtttcagaaccctcacaatcagcaaacagctataccctcacaacccttgcacacactcttctgtgtcctacttcaaccctataagctgtgtgttcttggacaacttactgtcccactctgggccaggttagtttcctcttaagttctgtgacctcgctatgctcacaagagggaccattgctcaattcaactgatcagcctcaaccccaatcaatacccagcgagtgcccagctcctcagcctgtctcggaaaggccatcagagaccacagaagacatggtccctaggtctgtaagcttgctgaacacctgctctgcattgtctgttatcctgctggatcttcaaggccctgaacctgccatggtagcagaagtagcaggaccttgggcggcttttacacacagtattttgaagcaaaactagattgaggttataggatgcaggtggcttctcttcagccttggatcctccatggtcaagacactttcagagccctccacaatcatctctgtctgctcctagacacaggacccgggcttccctctttaccctgcctttatccaccagctcctcattttgccccaggagccttcctcctctgttggcagagtcagcttctaagtaaagagactgcttttctttgtttaatgacagataatccgtatcagctcaacttgatgaagacctagcaaaggactggctgtggtcaaaacctgccagcctccagggctagaatagccacagccgagcaagtctgagacaagtctctagtgggaagtcacactattctggtctatcaccattaccaacagtgaaatgactcaggcaagaaagttgggaggggcaatgttaatggggtgatgagagtccgtcctgatggttctgaagctctgaggggctgggcagaattagcaagacacagctgaaaatgatggcaggaatatgatggcaggctcgcacgcacacacgcgcacacatgagtacatgctctcacacatgtacacacatactcacacacctgtaatcctagcactagaaggctgaggcaggaggatcagaagttggagatcagcctgtgccactgagagagactcggtctgcctccaaacaccaaggaaatggtcaaccaccatcagaccaattgccaaagtcctattcactgacagcttggccagggataaggaacagaaggcagaaggaagcaggtttacctctctagagcaatgaatggttttcaagtaaggcggcatccccactttcccaaatgtgccgggtgttcttactgctgcagtgcttagggagtggggaggcagtcttcagaaaggtaaggtaggcagggcccatgatgctcactgcattcagctacccaggtcaagtgccaccccctcaggaaacgctggcacaggagatagaggctgggttagcagagcctagtgaggcagtgtcagcgtgctgtataaggccttgctatgctctgaaatgcttttgaccatgccaggtaaacgtagttgggccaccctggccaggcagagcacttggctttgatgtgtgcttgaggtcctctctggtttcgatttagaggacaaggttgacaccaagttctggcagtgcccggcggtccagaactgactacaggatgttctgggcttcaggtctctcggccaggcagaataatgagagctgagccgactgcagaggccccagtcattagcgaggacccacaaggggagtgcagacagcatgacgggccctgttgttgcagggtcagcccacagaatactcagagcatcagctcagcaaggcgcctgcgagataattaacagggaattgccagtctcaccacgtgcttttctgaggctggtgcaggggagcctggccagttcctaggtgcttgccagtcttgcaagcctgttcctgcctaggatctagggttttggcagacccagctcagtttcacttgttccagtataatgggtgtggcctggttctgctctacagtgaggtgaggccatagccctggagtgtcctgagacccaactggctttcagtttccctgagagtgcttaaattcctgctttggttagagggaaggctccaaactcatgattcttaatgttctatagaggcatctgaaggacaaggtggggaaaaacgtcttctcatccctgactgacgggaagacgcaagccatttaggaggatttaaaggccaactgcttctcagaggccccgccctaggtattacaccacaggaggtccccacccccagaccccaggccagaaggcacctggatgctcacctgtgcgacagagtgggtttcatggagctcatggagctgagggggggctgcatgggcagtttcccaggggggtcgttctggcggctcttctgatgtcgcagcagcagcaggcggccaagttcttcacaccaggaggacagcagggctgcaagcaaagacagatggtcagtggacacactcgagccccctctgcatccttcccagacgtggcgtttatgaggccggttttgctcctgggaaatttctaaggcttcctggtaggcctcagtgttttaaactataaaatggaccaaaggcaaaatcagaatcatttgtgacacgagtccactacaagggccagctggaatggccaccaggttgagaggccccaaagaacagtcccgacaatgaagagaagacggagccaagggtgagatgaggggaaaaggccaacagaggccttggatcagggtatgagcaggcacttctagggaaccccattaccacatactcaggacatttagtgctcccatgggtgtgttagaaactgtaaagtgtagacataacttagagctttcttggagttgctgaagacccagaagcattcgctagactctgaaaccccccagccagaactctcctgttgagtacacatcaaccttagacagaccgaccgacagacagacagacagacatgcacgcactcactctcattggactcaaatgcttggaaggattgaaggtttccatagcagagggtggtagtgtgtgagtgtgaggtgtgagtgtgtgtgtgtttgcactagagacagccaaggcagcatgtgcaagagtctctgccaccagcccaagactacagtgaccaatgcagggggaaagaattgtcctctcttcatcccagtgtcaccactagggactaaaagtttccttaaggtcctttcaggatacagccaagtttaggaaagggacaaggttaaggctgggcttgtcaccacatcccctgtaagtctcagagtacttggagataaatcggggtgtggctccagccgcagatgatggccttgtaggacaatgagaggagaggccctaggtcctgtgaaggctctatgccccagtgtaggggaatgccaggacagggaagcaggagtgggggtgaggggtgggatggggggtaaaatgtctattaaaaaatattttttttcaccaaaaaaaaaaaaaagaaagaaagagagaaaaaaaaagaggggtatggatttttgtcactcagtgctcaaagccagagtgactttccagaggtcgagtcagcgtccctgctctggaaaatctgccttcagcagataagccgcagttgaccttcctctcttgactcctcccacttaaataaggaagctgaagtcagcactgctaacactgggggacatgcccgatgcaatctgaccaggagtgctgggtgcttcaagctgccaggccctgcacgggtcctctctcagcccacagctccgacggctatcactggggccgtgccaccaggtgcttgctcatcttgccagtgtccaaaagctcctgaccaaggatggaagtgggactgtagccctcaggagagcacccgtgtctcccctagaggctggtggatatgctgatgcagcttgtccttctctgtgggtgttctcagtgtcaccaacacagggaggaccctgcccctggcacgcatctgctgggaagccggtgaggctcctagtgggtgcccagtgttcaagcgtgccaggagggaaagccgcctatccagaaaggctggatcaggaacaggtatgttttcagattgctccattctttctctgggcctcggttcggcttcttgcacagaggagcaggcacctagaagctcatttgcacgccaagcacgaggcccacagggttgcagctctaggaggcttgctgccagcacaaaggatggatgccgaccggctgcttgtgacacgcctcactatcttagccctgccctctgggtaccagccaggctgctgtgggatttagggttttccttggttaccggaggctgccctacaggtaaagggcaaggttgttcactatcccaagtggactggtttctggaaagataatgaaggcataggactggcaatggaaatgggaaggaggtgtttgttaactatgtcttctcatgcctggaaggccacaatccagtgaccaggagggaaagaggggtgacacagagaaccctcctccccctaccttggctaaaagcctggggagcacagagcttgagagcagccccctcacaatgggcaggagcaatgtgcatgcctacgaaggcttgaacggacaggggctatgtggagacaaacaccacatggaaatttgcagccaaaaagggagtatgggtctgtttacagacaggccaggcaggagcccatggggctgcagtgctccagcctggtgggaccaagcacactttgatctgggaaggcctagctgcttcctgaaggtcagttttgcctgcttgtcctgtgtaccagtggcaggtaaggctgccccaggatgggcaacagagactgttctggtcctaatttacacccttctctgtggtagataggtctgaagtgctctatcaactgtctagacagccagcactgttgccactcgtcttatcctaagagtctcactcccaagttgactacagccaggagcagtgtccacagaagcccgtgatctaagacctggcactcagaggcatgaccacaatggcacccactgcttcctcttctcccgatggacccatggcagggttcgactgtcccgagagcagaacacatcaagccacaaactgtcttttgtctacagtgcctggagaacagtccttagaggccccttccttacgcccacctggagcagcaggccttacaccacccatgtccaagcactgaaacgggtagccctgggagtctggcctctcagcctggagggagccagtttcctcactagctcatcagaacattccaccaagtgtcccagctaatatcaccacgaaacagtgggacccacattggagcccaactgtctactccaagtctcaacccagatttcaaactgtttccaaacttctcaacatggtatacaaagatgcataacccaatacatctaaaatgatcatcaaatgagggctggcaagatggctcaagggttgacggcttgagttccacccttgagacccacatgttggaaggagaacagactccttcgtattgtctattgtcctcctcatgtcacacacacacacacacacacacacacacacacatggatatatatacaaatagatgttaataatttaaaaggagatccattgaccatctggggacaggtgtcactgtgtagcttggatgacccagcactcactatgttatgtagatcatgctggccttgaacttcaagttctgcctgcctctatttattgttgagattaaaggcatatgccatcaagtgtgtggctctccacaaaaatgaactagcattttgttactaggttcccttcctattcattctcaccttaggtgccaagcgtctgatcgcccacctatattaatttgacaaagagctgctgaacacttactgagtgtagagcttcctgcactagataggatgccctgtataagccagcaagcaaggaggcaactctgtgcactgtgcacactcctctggcagtattcaggggtcagctgtattcagggtaagggacaatcacagatccaaacagttccacctgacttccacgcaactgttagctaagcactcacgtgctctctctgaacctttatctgttgatgagtatgaccctgatgcctgctcttcaggatataaggtgcttaaaacagtagcttgtaggtagaggggtctatgtagcattgtggccccagaaacctatcactcaccatgtgagcagtgggagacaacaccctgagaaactagaccaccactaggtgacacctaaacaaggtcccagggcagctgtgagggtggtctgagtcagcactctgaagtacaggaagactgcggacccatggtacgctcatcagatgatgagcatcagcccccagagttgacagagctacaataaggaaggctctgaggccttgctgtgtctgtctacttctgatctctgagcagagtgcagagccaatgtcctgggtgggtatgggctccagacacacatgggagacctgtgggtagacggaggcctcggggcagatgatgacgccacctgctcactcagtacaggctctgcattccgccctgtccctcccttcttgcccgagctgccaaggggcagaggaaggacagccagtgtcctactgtgagacaggaagagaagggccatttcctatccaggtgaagctgtgcctcttcagcggttgccccagaaagacagtttgctctcctgtgtctctgaggacatagctaggatcctctgtaccagtggtactggggagagcagtaagcacggcatgcccatgactactgaaaactaaagcatacaggaaagacacacggactggtgactgactgggtcccaggaagtgggtctgaggggatatagaagagccaggttccccacatctacctcttcaagatctttctagcaactactctcacaaacaggtactatcacaatgtcctttagggcaaggaggggaacaacgggagaggccccgaagactggaatgcagagccctaggcaccgagctcgtgaccgaccctaggtgtgcctcccctaggggcagggacaggccctgaatctgcttctttttctgcacctcccagaggagatcagaggaggcagaagcagcaaggctctaatttggggaaccacctggacacctggcgttgttcggaacttcagagatcagcttttgggggccaatgaggataggatccagttggggtacaggggaacagaggctggatctcagcatctaagacagtgagtacacagggtcataggaaaggttgaacctcactagtctgggttgggcttgagcttgaaaaggagcaaataaaccagagggagccagatctctgggcagcttggcaaggtttagatacaggcccaggctgctcagtgctttaagatccaggaactgggaaggaccagatgcagggaggagcctgaggagcagtctggagagcagggaggtaagagacaaacagaggctttgtccaccctgctgccagcagggaatgcacagtgagacaaggagactctgaggagcacaaaacatttccatggctagaaggcaccaggggagaaggttgtgtgtgtggagggggcagtagagataggaggggtggcttctgagtccctcaggccaccaaggatggactctgaagtagccaggaagagaccgtcaagagacaagggattcctccttcacacatcctaggaaggaaagaatgcaaggaagggccattcctccaataaatagctcagtcacgcatttcaggtgcacaggggacgatgacacagcagcaggatgagttaggcacttcctggtgagtcagaaagctaccaacatggccactctagtcccccgagcacacctacctatctcaagaatatgtaccaacatggtgtgttgatcgtctcagcagcctgctctccttacaccttctctactacaagctctgcaatgcatcagagcaggcccacccatcatgtgcctgtctcccaacgtgtctgtcaccaacccaccctgctttggatagacaggataagctgaatggaagcaaatggggccaggagacaggctacccaggggttagacatgagactggagcggccccttgcatagtcctagcacttggcatagcatttagtaagaactacgcagccaacacatgactaacaggttgcagtgcggcacagacagaaatagctcggtacatgagagtatgggagacggtcagtcatcaagcactccatctgaaagccaggctgtagagctggtgcaaggcccctcccggactgcaagccagtctccatggcactgtcaccagataaaacctatcacagagtccactgacacatttcatgccatgcatagccacggacggctaatgagactttataaatataagcctcttacagaaacaacagcgtaggtgacttaaggacagctgccaccttcatgtcatctgtcctggcaccagtgctgatggtgtctgtacatccactatgtggtacccacagaggaaaggccacctcttatccctctaggtggggccagatcacactctcaccttctcctctttcatctcccaagcacaaagtcttggtcccaaaaccaggtggctgggagtctctagcctgggctggccactctagaacgtatcagggattcacaggcctcggctcaccccttcattctgcgtgtgaaatggtgagacagcaaaactcctcttgtttacagacaaggatctgaggattctcgaggcaatagaccaggcttaactgtggaagctcacaggagaagcatcaggcttcctccctcctgaggtcaacattaaacaaattcagattctggcaagtggagtatcctgcaggataaattcactggttttccctgttgccttcctctgaaggccttccaaggctgagacatctgacaaacagaaaacgaacctggtcccttgtgggtctgtctttcccacactctaggagaatcacataaacatacacagatgctcaaagctgtccacttggcacctttatgtttgatactccctggggtgggcagtgccatctctggcacccaacagtggccacatccagtgcttctctacaaggctgacctccgacccacgtttcaccttgatctctacctactcccgcctcatctcttgtgccagcctattgaggctcaccctctgtaggggcactgagcacagggcctgtccacacagaccatctctgaaaggctcttggcatttaccctattgtgccctgaagggcgtgggagggcaccaggagccaggcctcctgctctcatggcatggctcccttgtaagagtcagtaggttggacttgtgtcctgaggaactgaaatgtctgcagagctgtctcttggcttccttcctgctggcctctgtaggggggccccagcaatggaggaatggtcccactctctgccttgggaggaacccacaaaggaaccccgtgaccatgaaggagattctagtcttgggctggggcaggtagctctgagtcactgatccggtaaagcagccttaggctctgcaggcacatttgtctacaggaagggtggccattctgaccctactcaccctgctgcagtggatggggaagatctgccagccaccacgcttccttcccccaccccctccccagctacttcacactctcagtttgactcccatgccttgaggtctgcccaagagctatactgtattggaggaagggggcaaggggtgtgggtggattcagaagatcaggacaatgaccctgccactggtacctaggacttcccttttatgtccctcatctgggacatcaaacccatcactaggagacactgaagtaccatcctagtttctcatctgagctgagctcaatacctgtgtggccaagagtggcttttgtccctttctaagttcaggagggtgtgtgggtaggtgggaagaacttggcagccttagcaacagggggtcaggacttcttggtggtcacagggagctggactttggtggtgctgacaaaagcccctggttttctgtggaggaagtactcctgaggaattgccacactcttgccaggcctttctcagtaaggtgttggcctaagcttctggttttcccagatcactctcaccttctgttccctgctttgccagccccggcactgtgtggtgtgagaggcaagatggcagaagctgcctgctgacacactggctgggaacccttccatttatccctcattcttatagaagcttaggccccacaggccaggactggtcaggtctggtcccctaactgctcctcaggctgggacagtgtgtgcttaaagaatcctatggagtgacccagcctggagtagcttcaggctactcctcccacctccacccctgcctctagaacactccctcttcccaagggctctatgggtgacagaagctggagtctctaggtgtgtgaacacaccctgggaactgaactctgaggaaccttagagcctgcaaggctgattcccaaaccggtttggctgttccttgccttgtggaggctgtccggggctgagcaagaggagactcaagaagattcctgaagagttgagcctctgggggcctcagaagaacccagtctgaaaagttccctgcacatttcccattaccatcaggtcagcctatatagttcaggctcagatgctaagactgcagtgccaagtcaggggagaatgttcatcaggaagagaatgtcctacccttaggatggtttcatctctacaaagtgtcctctcaaagtactgtggacccgaggacgggcttgggaagtgagctggcaatctggctcagttcatctgacagagagccacttctggagatgtccctcttgaagtagtggctccctggtcctcccacagatcctcctgcgggtggacagctacagctgctatccaggagaagtcaggagcctgactcaggccactgctcagtgtgtggcaggtcgtgacctttgtcttcttaggctttagggatggccatttgctggctagggattgcagaccattacagtaggagacgaaagagctttatgaacaaagcatgggggaccagtgagaaggctcagtgggtgatcgtgcttggtgccaagctaaagtctactcaaccttgagttcaaatcccaggacccaaatggtgggaggagagaaatggttcccacaagctgtcctttgatctccacacacaaacatagaaacgtaaaaaataaaacacaaatgacaacaggcctttagtcccaactctcaggaggcagtggcagaagcaggccagtttctcttgagtttgaggccagcttggtccacacagaccttatctcaaaaacaaaacaataacagtacaataccaataatccaagtgctggggatggtagctcagtggcagaacttttgcctagcatgcatagggctctgggtttaatccccactactacaacgtacagccacagaaacaaagtatgcagcactgaggggaaggggaggggaggagggaggagggaggtaactatagtcttccatttagagccttggacctacgcccataacaaacttctctccacagcctgggaagacatggattccaccagggcagaactccttggtgctcaaggacacacactggtgttcctaaggggctatttgaggactccccacctgcccctgcaacttcttcttgccctaaggaacacctgaaaaggccaaggatagcccagaggtggcaacggtagtaaaagggatgtagttagatggcctaggagaccagaatgctctcgcattggcctgagtccctaaggtgagaagacacccccctcacagacacacacacacacacacacacacacacacacactttattgatcgtggagctgcagcagggacagcctcaagatccattttccttcctgaacacgctctctcctacaggctaaaacaccactaccctctgttcaaacttagggaattggggggccaaggaagtcctatggaaatcctttgtccctggggaacctctgagacatgtcatcgaaactcacggtctgattcctccaggtaagaggctggagtgagccccacttcttccttagatagcacagaatccccaattctcaccacatcggcagccagatgacagcagatcacacctttatgtgctgagcaacccagctgtacactgtgtccaatcctaggggaaccagcaagcagctggtgaccactctcaggcccctcaaatggcagagctcatgacaccaacatagaggctctgtggggtgactaagtcttggtgagatgattgccccacagcaaacttgtatcaacaaaggaacaatccaagcagttctcaaaactcaagggcgtggggcatggtgacaggtgtgacaaggatggagaggcagcattcaaagagtgacccacacccttcactacggggttcgagcacactcagggagcacctactggccagactctgtcctatctgccctctgtctttaggcctctgacccctcatctcacccccccccccccccccccgagtcaccagatgcctaactggatacattttcagactttcaggatcctggtgcaaaatgcagacagggcctcctccgtccaactccgggctatggagttagctgcagtcactctgggacacacagctcttcttctttagaagacctctcagtccaggggctccaaacatggcaaacaggggtggttagaggttccttcctgcccagtcttcaagtgggttctccacgtggttgtggctgtcttcctactcaacaaatgagagcacagtttcatttctacaccttccctgactggctattctgtgcctcttcagaaaaagcctaatggagatagtgggtgagggaccatctgcgtctggctgtgaccacctcctctccaggtgcccatcggggctggtaggttaacagtctgctgcaggaaaacagctgactgatctctttatgccactggatcgttttttttcctaaaccacagggggtccctttcataccctggagaaacattccagaacatgttctagattgtcatagacactcttggttttagactgataccacctgaagcaactctcagagactctggatggcacacctaaagggtggtgaaggcacagagatttctgttgttgttattgttttacttttttaacttgatataattccctatggacttctttaaaatatcctgtcatctcattgcagtgaaagtcattcttttgacaccagggctgtggctttctggatacccctggccagtatgtaacactcaggatgtcccggacaggaaatcccagagcaagactgaaccatctggatttcctggccagacattctcctagtgcaatccttagaatcgtctggaaggctggttacaagtcctagactcccgtaactgtgggatctctgatgctgcaggacagagctgacgaatctgcatttccatcaggttatggtgatggtgacgctgtccagtctcactctgagaagcactgtcgggcccggcagcacgaaatgctctcaaggacttcaggaatggatgtgagaggctctctctcctttctcctattcactgacttaatattcaggggctctcaggaccagctctgtaacccctctttgggttacctttccaccttgggctgcagagcttcttcaacctcacactctctctcagaagaagaatcctgggctggagacaggagtgggtggagccctggttttatgtcagtttttggagcaaggcccaggtgggctatgcacctgcctcacctgcaggtgaccttttctgtctacacaggtgttctagtggcatgacggaggagctacaggtggagaacttgattcgggtcagaccctattccagtgactctgcctctggagtcctctgattgaaggtcttgtatttgggaacctgggtctgtccccagcagctctcggggccagcagctctcggggccaccatcaacagctggtgggctggctgagtggagctgaggactctgcatcttgtggccatagggctgagccagctgtgggatctcaggagccgggccccaggtaaggcaggatgtgatgggggagggagggcaagcacaaggcagacagcagcctggccatctgctgtgcagtcagtcccagctcctggtttctcttcagagcctctggaggaggcgaccgtcatttgtttaggcctctgcagtgttcaatcaccacacagcactccacacaaccctccctccatccctccagctcctgttctctctctctgcaggaaacagcttttgccttctgcctctgatggaggccatgaaaattaacggagcttgaggcgaaagcacggtggcaggaggggctggggttggacggccagctggccaggctgagcgggcacagacagggtgagcttgaggcctgaggggctggcctggctagacaatgggcaacccagcaaggccacaggaccacggatggtggtcagcaggctggagccagacttcacagtttggactctgctgggatcctgggctgagggagaatctgaggatgaaacggcttctttctctgaccttaaaagagccagctcgtacaggcattgtgtcctcagaaggtcagctgcatatgctagacaaatcaggacacccctttttctttgccgtcctgacagtgctgggaatcggtgatcactatgtctagtctcctggcccccagagacactgagagacttgccaaaggacaaccagcaagagcaaatggcagggggttctatactctttgaaggagaaaaattacttatgtacaaagtacatagatatatctctttgtagagcagacattcacacgggcaggaagagggagctggctccagatccacagttctcccaatacctgatccacctccctcttgtccttctgaagaggccatgcatgcatacaattagagtagtggaaacaagagtctctctctctctctctctctctctctctctttctctctcacacacacatacacacacactccacattgtccagatgatgagataggaagactccatcatctaagggctacagaagactctcagggaaggttcctgcactaatgggaagctgaccagctgtcatacaacatggagaaaaactagcactgaaatgtcccattaggaaagtaaataggagctcagtgtgctggcacatacctttagcctcactaagcactggggaggcagaggcagggggatctctgggagttctaagacaacctggtctatgtggcaagttccaggacagctagcagtataaaaaaaagagaggaaagagggagggaggaagggagggaggaaatgtaaaggccagctggctgaaataaaggagagagcagaagagagaagcccaagatgaacagcttgactccccaagacggtccaatgactcagacttctcatgaggagactccatgtcagctccttctagcctcctcttcagcctccatgagaacccaggacagaaagagcccaggcctcacttccctgctccacacagatataaccaagcaagaagaaacaaactgaagagctcaggagtctggtggggcttcgggaagctcgactcgacagggcaacggcatttaacgaatctcatgtcatccatcatctgggtccagccacttagataccgggcatttgattaaactaatatgggcggcagggcgcttcctaccctcgcctacaaattagaccgtcacacacgatccgattaccttgactgccacatttatcttgagagaggggccatccatcactcctcagtggccgactctacccaccccatgctaattccatcaggaggagagtcaagtttgtcccagccttgcgtcaggtggcgtctactcattcattcatccgacattggttcaacacctacccacctcacagtacccaggaagaaaatgcaggctttgccttcagtgagcccacggaagtggcatggcaggagaaaggtctacactggtgaaggcagagtgcatctggcgtacctgcctgtgtcccagcctgcctccatctgagaccaccctgtcctcaagtgtcacacttgggaaatggttcaagagcatagcccagcactgccatggaatttccccaactggagaaatgttctagatagatctatgctgcccacaaccaagaggcaaggccacacgcggctgtggagtacttcacccatggccctgcaaggggagctgagcttaagtctcatttaagcttaattcactgaattcgagtgtcaatggccacctggggtccctgcctcctgttgcctagcatagatccagcagctgctgtggagagcaagctcggtcctcatcgtgcccagcgcagaacatgaccctagacaaatgctcacaaagcctggatccctgcactttaggatctcaggccagagatggctattcatcatttgaagagcttggaacaggcactcctactaatgggtcattataatccaacaaggtgggatactcctctacttaaatccaagctgtggttcagaggtaaagacggtacaagccacaccatggtaaaggtggaaccctggtttgggtctctgtggctttgagccctgtcttcccaccaattggactcctggcactttaggagaaagtcagcaggactagaggctacctgttctgtgcagagaggccacacagccagccttcccatgccacagcaaagctggtggtggctacctccctctaccctaggcctgctgtagccctggcagtttaggacagagctggagaagccaccataatgtttagttgtaccaggtacagatgggactccatcctgaggcttagcaagaattcatggaagatatgctgcctctggcttcccagataccagtgagcccagctctgctatctggtgggtaggtggggctcaacgtggctttggttaacggggaagtctgggcctgactctgaccctcaggctgcccctggagaaagccacactattccttcacaatactggagtcaaacggatataaaagagcaactgtttattcaccattgagaactgtctgaggtcattcacaggtcaagtaccaggcaaagatcactgtctgccctcaggcctggagagatggcaactagggacaagctatagaatgtctgtctgatgacctcaatccccacagatggacggtatggccttggccaacccacctcatctggcagcttttagaatcatacaccggggcacaagtaacaagtattcttgaaccctcctgtgagcatcggacaagatgtgcctgccaagcagtcactgccaaggtggattttgctccacctggcacaacctgagtctaccaatcacaggcagactgttcttgctaggaacttaaatgcagtctgataccagggagggagagaaagagagagagacagagacagagagagacagagacacacgggcacacatacagaactggagattaatagtgcacacacacacacacacacacacacacacacatacacacacagacttagacctaaaggcatccctgctgtcagagacttctcacaaaccacactagaaaggagcaggtttggactactgaggctgcctgcaagccagaatggctgccctagatggggtatgtatgggagaggcctgagagtccactactgggctagggaaagagaaggaaggatgtggtgaagcggcaggtcagaagagcctacacagagaagctgacctggtgagttacagttgaaaaggatgctgggaggaggggttacaggtgagtaggttcccagattgctccctcgcacaaggtccacctctttacactgtcccagtttcaaggactacttaggcactcacacattggtataaacaagtttacaacaagttgtgccgacacagtcaaggagcagcagttgaagaggagaaaacagtgtagaaaaaatgacgggtagctcttgcaacgcacccttaatttccaagaaggcaccggggagcaccccatcagagaccctctgctaccaagaccaccaggattctcacacccctccccaaaatgccaacactcctttgttgccacttaaaccaatttgggggtaattctgctggcaattgtcttccgatttataacacggctctgtgattgcatccaggctgatggttcaggccataattgtatggtaatcacttctgtttatgatcgatgcggaaatcactattgttttccagcaggcttgttaaatccaagaagtgcaggggtgggggagggagggtttatgtctgagcccgaggaagatgaaattaactggtgcagcccaatgtgggggaaggtggttcaaagacacccttgtctcagaagcacaggcacagtgggtagcaggaaggcagcagatgaacaagctgagagagacacaagatgcccctgctgaacagtctaagaactgtctggcactcagatccatagagatgtccagagggacgccacagtcatacagtaagaggggagggtgctctttagtacatccatcctcatgcctgcatttatgagctacagagaggcagaggaaatgcagatgccaggaagcaggtgggctactggctgccctatgcttggagcctcaggcctttcaatcctaggtctacatggtttcttcttgcccttgccctgagatcgcctacctgctgtctgaaacaaggtgacagatggcacctgggggtccaggtggcaggaacagggcagtgttgtgagatgagctgctgttttgggggaatgaggggaactgcccacctggtgggtagaaacctgaacctcccagaggccacagggaatggccctgggctggatgggggaggaacaataccttccaaggctgtggcagacaccttaaggcacagaaggatagaaccagccaggctggaggccaacagccattcggagcacgagcaggtaccagctgtcatgtacagctcaggcaaacctggatgttgcaggctgagcttggctgcaaggtagatggttgtataaatgtacattcttcctccaaagcaagagtggaagagaccatggaactctggactgaaggctgggatagggagacccactaggttccaaagcccccagggaaacactcactcctggactcttctctgaggaggcttttctcatccactgaaccccatggcaccaactgacaccattctgactgcccccagacttggttctatatatggccctagctcaggctagctttgggcaactgtcacaggcagcttccctttggctcagcaagtttttagttggaaagaagtgtgcttacggagctggagagatggctcagcagttaagagcactgactgttctcctaaaggtcctgagttcaaatcccagcaaccacatgatggctcacaaccatccgtagttgagatctgacaccctcttctggtgtgtctgaggacaactactgtgtacttatataaaacaaacaaacaaatacatcttttaaaaacaacacacacagacgtatgcttacactagctgccttaccaatgtcagcctgggctcaaggccacccacctcattctatggttttcttcacagactgagtgctaggtttctgtgtcccatgctgtcacaacaaaagtagccagggtcctgagatcatagaataatttgagtttgtgtatgcgcagtgttggggctcaaacttgagcatgctaggtatgaatgagcactctaccagtgagccacatcccagctcctatttacttctcttaaatttattgcaagcaactatttcagcccattcttgaatggagaggaccaccccagagcccaccagactcttggggttcagaccctaaatttgcccttgcttagttctccacagccaccctgtctatcctgtaccagaaggggtttggggtgtgtgtgtgtttcagagcacatcagggcagggcagagcatgccagaagccaccagaagtagaatgaacattcttcattgaactaagattccatggaacttctaagattcatctcaagaaaacaggccagttctcccagggatttggttttctgaagtatgtcaagcaagccatggttacttaaggttcaacacaaaaatcagtttaataacaagattttttagctacaatgaagttttctaaatgcagagacaaagatcaaggtgggaaacattgtatcttctgcttttgttttctttttctttggaggttggggggcatttgtaaaagtagtgtgtgctttgctctctctctctctctctctctctctctctctctctctctctctgtgtgtgtgtctgtctgttgtctgtccgtgtgtgaacaggccagggcatccacatgggccatattggatagagtgtcatgagtatcatcttttggggtcatggtgtcattctctccttaatacatgggctcctaaccaagtcccggactccaatagaaattctgttgtctggatttccaattctttgggacagtttcagggaataggagatatggcttgcaagggtctcctgatggtgtgagagactcagtatgagaagtgagaaagctagagagctttcactcttgctgacagcccaaactccctggctccacacgctccattagtccatgacaatacctccttttctggggagagagtgcggcatgggcaggaaagtcccttctggactctgaagagctctaacaacatctactgtgtcagcttatcatggaagctttggaggtagccggtaacctctgacctcaacctgcaatcaggagcttgagtcagttttaagataaggtcacacgggtgttgttcctccttgtgcctggtggtaagaggactcaaggtgagaagctgaattaccatagagagatccttctaccctagacgtaacccaggtggctgtgactggagggactgcactttgagggctcagagaccagtctttccagggtcctttagttctggcgccaagcagggagaggacctgacaagccctctctgttggatgcccagatgctctgctaagaaactgtgaaaaggacctctgcacagataactgtaatgacgtgcacagtatcttcctattcctggagatggcagaggtaactgggtgccaaggagaagccacaggattcccttccctcaggcctgagagaatcatatacaatcagattcccaaggatggagcaggctaggaagtcaccctggctttctgctcctgtcctgagagctacctctgggaacagtacccttagaaatactctactggaatggcaggcctgccttcctgtgggcatggctcagggtttgctagcacagggtagctcatcctagcccttacccgacggtatccactgacacacctacatgctgtatcctttgtgctaggcacactggtcacacacgagtgtgcacacacccacaagaacaccaccccagagcctcatctatgactcaatttggaaatgtcctttactggtctataaggacacacacatggccctatacacacacacaaacacaagtaatgcttgtgttatgcatgcagtctcggcaacaggtctaaccacttcgcctccagatacgagtgttaccctgcacatcatgtgctttgcagtcccactggggggactttaaactcccaagaaggcagaggccccacccagaacctgctctttgttcattcacgcattcaaaaacatacttgcttgcatttcacctacccggatgctgaacacacaaacctggatgagccacagctgccgagagtactgagcagtagcagcaggcagggtggggggaactaggtatgtgtcagagtaagcaccacagaaagggcatgccgcctgggcccccagcagaatgtccgagacacacccggggcaggcacagctgagaccgtggcacactactgatgtttacaagcttaaggtagtctgagtgggggacggcacagtttcagttaacaggacccaggactagggaagctggtctgaacgggcctttctaggggctgggtttcctttagggaagagtccatggggcacgcctaaaggtgggagatcccacaacctgggaagtaactccagagaaaacggtcccagagaaaacggtcccggggcgcccactggacaagagggatttgcctaagtcactgaggtcctttctggagagagcccagtactaaaagctgagaggattaccaggccctggtcagcctggccctggcgagacttgattctaggtcagatgggtggctggagggaaactggtagcggcatttcttttgtatcccaaacagtctgcttactgctcgctgggcctttgggtggcagcaggaccaggaaagagacagaccctgtgctgtgcccacaaaggaggaagcgggagggtccttctcacgtcctgaagatgtctgggcgcttcttctgcttccagttacctccctagtctccactgtgacctagtggagacccactggtcacagccatgtgtggcccagtgggtaggacagggattttatatgttgagtgctgacttctgccagggcatccctgggactgtctgggaacactgggggatggtggttggaaaaaaaacaaaagcatgcacacccaaactatccttaagtccctgtagagaaaccacaaacctttctcctgaggtttctcatggcatgaggcctggtggaccccaggacaagcaaggcacccaggtttctcaggttcaatggaggctgggaattagggtagcgctaagcaatggagcagtcgcagaggaggacaccagagagagggtttgtggctaggctgtgagtatagtgcctgggtaagaggcctctccctttgaggaacaagagggtggtacccctctagagggcaggtatatgcaagtacagagacttgttacagagctagaagagttaatggttcattagaactgaccaggttcccactgaaaaaaccaccctctttaggtgtactgaatagcaagaatcacctcagtgtagctcagctcaaagacgctctgcataagaagccaggggcttccagatgttgatgggccacacatagatcccagaagggaatgcttgtgtgaaaaatgtgagggccttaggaaccccatgaagactcccacccagctcaagcctcaggaaggaaatgaaagcggctgccagcacttgggtacttcctctccagctgggacatgagctggggcttcccagccctggtcagtcaccagtgtcagtcctgtggctttacaccaggacagcagacaacaagaacacccgccgctctccccacacggtttcagaccacccccttacctcccccgggtgtggtggccattcacaaggaagggatgggcatttctgtaggggcacagccaagattctgctagtagtacacaacaggaaactgaggcccagagaaggctatgggcaagtcgggtcaagagagaacccccacctcccgggcttggaactccaggagagtctgagttaagctgtcatttacagggtaactactatatcccagacacagagctaaatgctccgcagccctgtgatctactgcagcctgccaggcaagcagcacagatgttttatcgatcaagaaacaagcatgaattaagtgacttacccaaagtcacccaggaaactacagatgtgggtttcataattacgttccaacatggcttgggaataccctgggtgaccctgttttaagaggcctacatgcgtcggggtgatggtggtgatggcaacgggggccaggcaggcaggtgagtctgaggccctgctgcagatcctacccccactacagacctcataagacatcttcaagagacctcagtgacttagacaccacactgcccaacagaacctcctgtctttctgggcgttgttgctacaccattcaatatgatatccaccaagaacttcaaatggtgggattaaggaactgaaaaccccaaatcatctcattttaactaatacatctaaacagctacacacgctgggctgctcacacttgaagatagcctgagctacagagtaagactgtctcaaaacataatccccaaattaaaaaacaaaaacacaatcaaataggcacaggtagctagctactgataactaggtggagttgtgtaatagacctgtgaaaggtgggaccccaagaaagagaaggactccttaagctgtataccacaaaggcatcttgacaccccgagcttaggacaagaacctaggtaaatatgctctgtacagagtgattctaactgtttgtttgttttggacatggtctctgtaactgaggttagcattaaattcatggtaacccctctgcttctgcaggatttcaagcacttcctagatgaccactcctgtcatcaccagcctgtgtcctgggctgctcatgtaacacaaaaatgaggcacccagtattgacatccctcatacataacccgtctgcccttacattcaagcaaggtgacacctgtgggtatgtgatcacaggctagcatgtctaaccttttgacatcgtgacataacactgtcattacaaagcttacacttgaaaactatatagctgaatcacacacacacacacacacacacacacacacacacacacacactgcagaaatagctcttaatgttttaagtggctataattttgtgttgggctgtatttattctgctatcttcagcagcctgtgctacatgctgctgtctgctggggaccagaggtagcttcctgggtggtggcattgggctgggtctagatccagcagaactgagagatgagagagggttccaactccggtcttatctttttttttttagtatagaaggtgtgaagagttactctgtatctggtggacccagtcctttatttactgtgtcaattaccaataaacagaaggccaagtgccttctgcttagcttgagagcagaggccatagactcaacctccagcattgcaaagaatagaaaaagaaaggaagggaaggaggtagaatggagatggggagggagaaagagaaggaataaggaagggattaaaggaggaagggaaggagggaggagaaaagaagaaaagggggagggaagggggaagaacaggaggaagggaaggaaggaatagcaggcaggccctgggggctgctgcttcttttccctttgaatgatgctcccacccaccaccaccatttttcaaagtcctcctaaggataagtagagatggaaccagatgttgtagaatgttctctgtctatggctattccactaatcagagacaaactcttgggagacagacaaggtcctgtaaatcatgagatgcctcaggctctgaccctggggacaaggattaaatcctggggcaacaaataggatgtgagaagccctgggggggggggtgttctctttaacctgtccccatagccccagtcttaggaaaatgtccccattgcagtaaaacttcccagacctgcttgggacccaaggagctacagggccacaatgtctattttccctctcctccctctctccaggagagctgcctggggagatctggacaagttccagcaagttcccagagctctgggggatgtggagcactgcctttgacccctaccatgacaactgcaaaacaggagctctgtgaccagagagggctttcgttttgtcagcagaagcaagggtatccccgctgcaggatgctaacctcccctcttccacggcagaattacaacacctttgcttctggtaactgtagttctaggagcctcagtggctccaaagtcttcaacagctctcccactgccctagggaatcaaacctgggagggagggagggtttcagccatggggcacttagccgccactggaggttctggtccgctgacctcccatccagtaccacacctcaagcctcactcactcacatgacatttattatcccgctcactcatttctgggaaacttcaggctgatccaggcccaaagtcaccatttcctgctcccttccccagctccaccgtacagacgagatagagcagccctatcagagccctcagccccaccctcacccccaccccaaggtgacttgtcaaaggttacatgtacatgttgcatgcagtacagatactattactggagggctgggccagaggaattgtgtttattctgaacagtgtcagagtttgtggggagcgcatcccagctgaaatcaatcagaggggcctcgctgcagtaaaatgtcatcagaggctggaccagcccctcaggcaggccgttgccctaggctaggcctcacctggaggcagggctgcagaagaagccacacgattatgcaggtctaagagatgagaagcccagagtgggcttctagtggaagtcagggacacagctaggctggctacggtgagaggaaaataacctggaccccctgccccaggattctcatcgcgtggacaggcaaggcttggctcccggcatcctctgggaggggtccattggcagagagactctgaaggaaaggcagcacggtaccctgtaagggtcttgttaacagggctgtaaactgagattgcaaacaaagcccctctcggccttcaatatcccccctccgccccccctagatgggtctggaggactccctttcgggtatgcagaaagccacccctttagatagcccagggtctagccaggaagagactacacagggacagaaatgcaggtcactagtgctgcctggcttgagtagaggatcagggaagaaggcggcagggctcagttcaattgttagcttccagctctcagtgaggggcctgtagaagaccaggtgagggaagagacttgctccatcccacacctgccctgctgtgaccttggtctctcctccccaggtaatggctgttgtctgtctgtccttccaggcctagacgtactgctcaggagctccctaggaagctggatgtgctctgagggtgagggccttgtttttccccgagcgagctcccttgggaggtggctgctgtttgaaggcccgggagaggttcccaggcagttggggcttctggggagcgagtgccagagcaagcatagcccagtgggtatgcttcgataccagggatagtgggccctggaggaggacagcaagggggtgtggggcatggggctgtaccatttgccaggtatccagacctccctttacccctggggctctctctgctggtcctttccttctttctctggagtgaagcaagcaaccaggctacctgcccagggatgagtctctttccttgtggagaagttggcttctcctgagggacccaagccacatccagcaaggtaaacaccttccagctccagagtacctttccctccccttcagccctgccagttcagaactgcctgttctgaggaccgtctgatcgatacatgacttcacagagcctgacgccttgccggcaccatggcggtcctcagggaggtcgcccctggactgctgcccatacatgccccctggctgacctctgtggcacagcagagtgctggcaactagccctccggcaaaatttaaccccagtattaactgcaaacactggctagtctatgcctgccccacacagaggctgccatgactcaaaactgttaagcatacggaaaacctaatctaacaggcttatgctgacatgaggtgggctcacctcgagctttcacccagcactgtctactggaactttctgccactagaagacagctgttttatagtccaagctgtccagtagggtagccgctagcctgtgcagctattgagcataagaaaccaattccagctagggatgtagcttggttgatacactgcttatcttatgtgcaaacagcactggcttaagtaccggtcacaaatcaaactgggctcggtgacacatgcctaccatcccaacacctgggaggaaaactaaaagaactaagcgagtattacttttattgttaaatcagtttaaacttagacgcagccctatgtggttagaagccaccatattggatggtagttttccactgagatcaccagccatccctcaatgggggtgacctagcaagggccactcagaaagaccaacgcaggacgctggttaactacaccaggaactcagtttagacctcctaggatctgcatatggttgggtggtgagtaggagctcaatccctgtggacagagatctagaagtgctttttaatcctgccgtaaggttcttctacaccttcacacacttgctgaacagtcactgagcatccactcattgacaagctttgtggtgggcagtggggtgcatggtagtaaggaacacattgctttcctccgttccctactgggctgagctggactaatccccccccccccaaaaaaaaaaacacaccgggagccttctttctggagtgtgtggggctgtgaggggaagtgttcacggtggagggaagctgtgcaggggagagtaagagcaagcagcctgaggaagcaagtctcaaactctgtgcaggcggttgtttccggtacagactcagattctcaccaaagcttcgccgtttggtggtttctcactaaggaagtttggggtaaaaatagccctgaagggacttgattccagctacttacagggtagtcactgcctggttaagatatatatatatatatatatatatatatatatatatatatatccttggtctgatttctagcccacacgtaaggatggactgttgagaaacactggtaccaatactttggcagctgcttcacaaaacctccctcttagaaaatcacctgctatgcccaggctcactggtagttaagcctaatggtcaagtgcacgctatgcctcggccacactgtaagacctgatgctctcccaaagcccgtctaaggaaccctatctgccctcctagtcttactgcagctggcttccaggtgaaccaagaactgggacttatctatgcactggttaccaacactaaagccaaatgctggggacctctggcagctgcttcttgcttagcccttgcagtgttctgagaacctctctacaaggtcttcctcacagccggatacagcctgatgccagtcaccccccaccatcaccagcagcagcaggagcaacagcagcaggagcggcagcagccgcctttccagtaaacacttgtcagaactctgctgtgcacccatcacctctgggaagggagccctagagccatacaagcctccaggtctctccagcatcaaggattcattctcacaaaggagtagctttaagttaaaccccttagccactgcctctaaccaaaagggtctgggctagctctgattttttgcaaagggaagcctaccagggatgaagccttgtaaaatgtctgctggggaaccagcacttcacctttaggaaagaggcgtggggatcaatctgtctggtcccccacccaccctcgcatccagaggaggaaccaaggtctcctctgtgggtgaacaaaatgggcctggtgtacacgctgaagccactcttacggccaagcctcaggctgacaccatgcagcacacggtgctacccacaatgcactggctctcctctgtcacacacatgcacacacactcacccccctccccgccccacgagcctggcgcccgcacccccgccccgcagcccgcactcactcgcgtgcgcagcccgccggcccagccacttcactgcgagggactggtgactagggatctgaggcagctcacatttcaaacttgctcgcaggggtggtgctggtgcacgccgccgccagagcgaacgcacgacccgacgagtggagctccagcctccgggcgggggcggcgaccaggcccctctccctccccccgcctcggcaattaattggaagcaacacttgtgagagtgggctcctggagcgctgtcgcccgagggggcctcagggaaggcgctggcggcggttgactccgggtgcctcccgcccccgccagcgaatcttcccaagaggtcatgctaatgagggtccgcagcggggccggggtggcctccgcaggctaaggggcggggcaggctggggacatccagtggcaacttgggtttaaagggctttctgaaagggttagtggggacggagatcagcagcttggcatcttactcccccagcttagggggtccctgtagcccctgggattctcggaacgcccgggccagggtaggtgaactggcgcacgtacactctgcctccctgacttcggggagttcctgtgccccgcagccggcggcgggagggaagccggaggcggctgctgtgcacagccccgcccctgctcccggtgctgccgtcttcctgacactgcatcctgtggtggccgcggcctcttccttccagccagtagttgcaggggcgcgacccgtgcttgcccctcccactcctctgccccataggcacccctggaaacccattagctgtccagcccaaagaggtcggatcccctccctcctttgagggttctatccacctagatcactcactagggagaaactattttataaactccccccaaaacccgcccactcaccagtgaaagttgtttgaatgagctcctaactgcctcaattagtcgaggaggaaaggctggtcactcaccctcaagaaagacagccaagagcggctttaaattctctgcatctgcacactgatctctccagcttggggacttgaccccctttgccttggaggctccttcttgtgagcctccttcacacgcccctccagtatgagctccttcctgactggcccctcagcgtttctgcttgcctcgctgcgggccacagaagtggcaagacaaatcacttatctagacactgggctcttactccttgtttgacagaagtcgttagcaggctctaatcccacccactgccacttgaaatatcacttttgggatggcatttggaaatgcagttgtcatgggctttcccctcccaggagctggctaaatggattaatttctacttcataactggatttttctttttgcccaagaaccagcttctgcaaaggaaattaattggcctctccttcctggagcaacctccaggcagtgctgagggacagactgactgcattctgctgtgcacacgtttcaggtggggttcactctcatctcctgtagcataatggcttctttgaggacattcatttacccactggaatatttactgagaccctgcccctccaaacatccaccacagagttttgagactccaagaaactagatgaaggctctcccatccttcccactgctcagcatagccagctgacagagcaggacactttggcccacatttcagaagcacacacgtccctaagacctactttctggtgtcaggctaacttaacaatatcagggctcagtttcgattaatccaagcacgaaagcctctaaataactagaacccacaccccatcctcccaaagttctgtacaatgacagtttacaattctcatctgattcatagggcctgttcagtggccaagggcttacacacacagtagcagaaagaactaactttacaaagatagtcctggggcaggagagatggctcagtggttaaaagaggtttcttgctcttgcagagggccagaattctctccttggcacccatgtggcagctcacaatcatctgaaactccaggtttagggaaattcaacaccctcttctagtccgagggcaccagacacacaagtggaacacggacatataagcaagcaaacatattcatacatgatatatacatatataaataaaatatacatatattttgaaatacatatattaagaaagatcattcctgcaggttgagtgaacattcaggctggaactgagcaaagtttacaccttaggggcagggacttggtggtggtaatcctttagaaattataaagacagcttcccgttgttttgcctcctcgtcctcctacctcttagttctcctcgggacccacttcagaagctcctgagtgggaccctgaggatggaaataatattcaagatacagggttttccaaggtaacccaaaaagtaaatactcttcactagcatatttacatacttaagaaaacaaattgttttcaagcacccattcatcagtccaaactggcccctttcacttgctaatttctaggctctcttctctggaatcaaatccctcaaggccctcttggttagcagcctctttttagtattggagtctacagaaatgccggcactccacacactatcttcgttagaagggctttccctgactcgctccaagttccacatctctaacttccaaagacttgctcaaaagcccggggcccacaggccaaaccccaccccaccccaccccaccccgcagtgcttgccttgataaggatctacaaaaagaggcagcagacaaaggcatcctgcgactccacttccagacgctctgcagctcttggagtgacctcggcaagccccctcacccgcctccctcggacccccccccggggggggggaatgacttggggggtagaagaaaggaagaagaaagaaagggcgagctgtagccccatgctgtggctccttgatgaatgtctgccaggctccggagacctgactaaggatcaatagcgggtggcttttctcgcgggggtctgaactcctgtcgtgggcctgagtgaagaggagccgccaataaatacagtgctgtggcatggctggctggctccggagtcggggatgctttatcctctggcagtggggagcccgccccctgaaggaccctctagaggaggggtgagaagggagataatgtagccaggacaccacagtcccaagcttgggtcaaaggactgacttccttcagctcatggatgagctagaatcagttccaataagacaagggaccaaggcatctacctgggatgcatgtaccaggggtcaaaagtgggtcacttcccacttacagctttttctttttcttttttcttttggtagtgatatggtaagtctaggggcttcgaaggccatcaggaagttaggaagaaaggaaggaaggctaactaagtgggcaggcaggcctgtcatgcacaagccaaactctcaagatgaggagagggagaacaaccagccttgatgtggctcagattctgggcattgggttctgagtcccagagaagtcccagacttctaacccaggcagtttgctgactcagagggattgacaagaattctgatgacctggagagatgtcacttctgtgtactcaggcactaactgggaaggtagggttaacagggagatggcaagtgggtgtgtacctggtcgttgggaagcgtggagaagaacaaggggggacagaaaggaatgctgctccggagcaccataaagagactgggtcacagggcaccagacatacagacagctaaggatcaaatgacaacactgagtgtgagtcacctccaggagtgggctctgcctctgggaaccaccaatcctggggcttctgtctccttctgcatggtcaggacacaaaggacatccttgtagcactgtttcccctgccattctcctttctcagccctgatgagtctctcttactcttgaagagggaaggcacaggcaatgtttggctcgtgaccagtacggagcctaaaaggtcgcctataccagggacacagtgcagggccaccaggctgggctccccttctattcctactgacacctggccattgaatgcttgctggctgctgtatgggtttcatcatgtcctgagcactaacttatagtatccttaccaccctcttgtgtcaggagttattatgtgccacatggaaggtaaaatggggatagactgaccaggtgaagtttgctaagtatctaagctacttctcagccttgatacatcctcagcatgctgcacattatactgtctggcacgggatgcctagactcagcactgatggtgcccacctgggccacacagccagcacagtgtgcagaactcttatatagctcctagagtatctctttttaaactccaacttgctatttggcctatttgctgttgacagaggcagctcgacctgagatgacacaggaaggagacctcattacctccctcctcccattatagtatcccctgccccttccgggaatcacccccccccgccccacccccagcacggctcctcatcccagacccaggcagccttctcagaaccctgcatttggctcctgcccaaatcctataatcatttcattttgaaaacaacaccagccccctgtccctcacctccactcagcatgtccgagaaaccctacaatttccaggttattggagatccaggaaagctttctgcagggcaggcagtgggggaagggggagtgaggtgggcatttaggagctggctcagaatggccctgttagtcttagggaattgcttgccccctacctgctcagctggcaaggggtccaggctaaggctctatacttgtgaggaccccctcagtagcactgatgctgatggagagcctggcctgcaagggcaggagctgcccccagggctggaggagaagcaagaatcgagttgctgtgttcctggactccctgaggcactcaggaggcagaggtttaagagccaaacactagacatgctagctgggttttcagaatctactggacttcaaatgagtgagaacacccaacagcaggtcctatagtgaaaaacccaactaagacagttgagataggttgagaagtcatggtattggggtaaattgtatgcttccccaattgttgaagtccctaggacctgtgaaggaaaccctatttagaaacagcattgctgaagatcaagttaagatgaggtcatgagtgtgggccctggtccagcatggctggtgtccttgagagcatttgggacatttggatacaacaagcagacggtaccctcttcaaggaggagtgagaaggacagtggagactccagagcctgcagtggttttgtagcaccagctaagacacttctagcagcttggaggagccctccttccctggtacctacataggagcttgacaggacccacactttggttttgggtcttttgggcccccaaactatgagatagttaatgcacaccattatggtacatgtgttgggccctttattagtggttgcccagaaaactaccatgaggtgatccctttgaaatctaagtcacagcccatcatgattccagaggttcttgctgactcggtcctgattatggcttatgatgtgggtctcagcttctgtggccagtcactgctctaaatccatttccttagtgcctctgttgaccctgctgcagcctgactccagagttagccatcctgacttggctccctcttgcagggtctcccttcgctgaaagtccttcctcagccacactgttccaagctataatccttcccacctcaccccgtgcttcttctctatcttagctttgccacactgatgtttcaagtatttattttgtttacttctgcctctctggctaaaaggcgggatctttgtcaactggaatccttgtctgatacacgctgtttgaacagcatctatgtgtccttacaagataataaatactctttgtataaaggagacaaatagctacctgaattaatgaaggagcgaagaaatgagtgagtgtacactggctaatcacaggctccagagatctgcatgtcctggctacctgtgcctgcctatccagggactaggttgccagcctgctgtctggcagaacacaagctatttcccaggaagtctatttgaacaggaagctcagactggccaacaaaggggccgggaagtagtgggtacaagccacatgagtcaggcctctaatgaatctttccccattgctagagttgcttttgaagggaggggtacagaggcagctgagacattcaaagcacagcagtcctgggagaggggctggggggagggtattgcttctcccaggacacaggcctgatgaaggtttccagatggcttcaggcctagacccacataagttccttgaatttggaaatgcaatttcctttcttgccagagcagtctgtctgtctgtctgttgtctgtctgcttgtgttactgtacacttcccagtctgttcgaggcagcctggggaatagcacctactttgcacaggacaaaagtgaggttcagatagggaaaggactggatgtgacaatgcacaccagccaggtgggggaccaggcagggctgcaacccaggccccctagcagctcatctttttttttttctttctttcttttttttttggtttttcaagacagggtttctctgtgtagagaggctgtcctgaatactcactttgtagaccaggctggccttgaactcagaaatccgcctgcctctgtctcctgagagctgggattaaaggcgtgcgccaccacacagacaactcggcaggcccgtgagctttgccaggaaactgctacctggtgccatcttcccctcttctccctgtctggggtgagaaggagctctccgggcgggctgcctgcttcttatcggtgccatttcccacagcggcttcttcctctccccagtgtggtcccagatgtcccccacctccaagggttctggacgtgagcagacaggccatgcaggaatgtctgtctgggcaaaatctgaaggtggccgccagggcggggcgccgggtaggaggctcgatgttgaaatcaggctccttggagctgagctcagctgagcagcagatgtctgacagggagaaagctctgtgggcctgctgggggaccaagggcaggtcgccgtccttttctgggccctggtttccttccatcaccagggaagtcagctagtgtggattctgtacctttctttgtgatgaagggcactggcttccttaagtctagctgggtaaggtcaccattggggtgaccttgctcatgccctgggaaggtggcatggggccaggcaagagactcccaatacacatcgtgctgtcaagaccaagaagctgcctctaaaggagccaacatgccacacttctttgcctttccctttcccggagcttattaatgaggttctaattctcttagaccaggtactccataaaggcagcaaagcagctctatctattttgttcacttctgcatccttgatgattttgtgcctggaccaagacaggtaccggacaaatgattatcgaaagactaatggagagctaccaacttattagtttactggtaggatgtcagctctaccctttactgtctatattctacgactaatgtccaataaacgacacgtattatttttaggattaaaaatgcataaccaactttcattttaaacttagtagaatctaaagtaaagactcccctccccccaccttttctgaaaagtgctatataccgtattcataaccagggtatcaagcatgaaacaatttcttagcaccaaccgactttcagaagcctggcgtattggcggctcagggtgaggtacggccagttgaaatgctgaagagctaccctctctctctcccagcatgtttggcttccaccccagtacagtcttgttcccgtctctaaactgtattctctgcctctggccctagcttgctctccctggcaaaggcttctaaaaggcaaagctgaccatgtcacttgtgtgaacatcaaccttgctttctacagtagccaggaccaagttccaaggtctagcatcttagactgccattcatggcctcaagtgatgctgtccttggcttggatggcttttgtctggtgcatgctgtggtgcctgtgtgtacggacctgagtttgccttctttattaatgttactgctctccctacgtgtctgttaacatgctgggctgcagccagctgccaacatggagttgggaagaaacctgttggccatgcaggagtggcagggccgtggaggctctcagtcttctgtccaccaagctctgggatgttccaggagtcgaggaagaataagtctctgccagtatctcaggctgtcaaagaggcctcatttctggtccaccatggcatgaggatgctattgtttgggtgctgtgtccctctagaaatctgctacctattaagagactatgaagaggtggggcctgtgggaggtgagaaggtggtgaggctataccctcgggaaggagatgatttccttgatgaagtggcttgaagaagccctgtcactcctcctgtcaggaaaaggatgcaggaagaaggtgccagcagatatcaaggacccccccaccaggcccatatctgctagcattttgatcttgtccttgccagcctctgtgctgtgagctgtagatttctgttgtctataatgcgctcagatcgatgtgttttgtggtagcatgttgcgcatcacctgctctctgcttcggtttactcagtgcacgcgcagtgtggcagccctgggttccaagccactgctgctcaatgctctggagcacagagagcccacacccaccttgggttccagacagacctgggagcatggtatgtaattgaatttggcctaattaactcattgagctgaggaacaactattactgacagagccctgggtgtcagcggaggctggaaatcaggagccaagagagctcccacatcctcagaacccgtaactcctcagatgctaggagccccagaggtaggtagcactgatcctgtcacacaaaagaagcagctcgaggctctgagtgacttagtagagattgaagccctcattctctgtggccagggcctctcgaccatgcactctcctctgcctgggatgtcattctcacacacttctcagagcagctatgcttatgggggcatccaaacaagggttactttctcagccgagccttcctaggttctcagccatgagctagctgccttcactgtcctttgcagaggcctcatgctgtagggggaggagtgctcagctcacagtgttcactgtccagcacaggctcaggcacacaggcctggaaggttgggggaggccctgcttcaaggcctagagctgggggcttcagatgagtcctcaacttgaggtgaggaaaacaaggctcagggtcctacatttgcaaaaaaaaaaaaaaaaaaaaagctagaactttatgggtctgggcctgcctcagcctccgtgccctctccctaggtcaagggaaagatcaggctgacttaagcaaagacaagcctctgcgtcccaaggtatatggtatatggtatatggtatatggtatatggtatatagtatatgggagttcagttcagtcaatctgagttggtggcccacttccataggtcaggaagcagcgctcctgcccacttcaacctcctggctgtccccagtcttctaggcatccctcttcctctttcagggacacagcctgagctgggactcaagtgtgcctaggtgtgagttctagtcccaccatttgctacttgagggatgtccagcatgtcactcacctccctgagtcccagctgaagatttctgcaaggagtgagagggagaacgagtgtgtcatgcttgcccagagtccacagcatgctgaagactcaaagcatctgctccccagcgcttagtcagtgcacgggccgagcagtgcctgtctaaagtgctgggtaccagaagtatctcaaatttctaggttcaggagatagtaaaatatgtgcatatacatatcctgggaaggaaacccgagtctaacagtaaattaatttcccaatcacaggcaccttatgtgcaaggagtctgaaggaaaaatttaacaacacagtgtacttactgttaaaactgtatgcaacaggggcttatagagatcaggctaacctcagggtggctgagggtgacactgttttcccacctctactgtctgagtgctaggatggcaggtgtgtgccgccaagtttggttttatgaaatgctgtggttcaaagccaggcaagcgttctaccaaccaaaccacaccctggtcctgcattgggtcttgactgtgacctgtcttacggagctgggagtggaatttttcatccttgagtactcaactgccaggcacggtggggaagacctgtaatcccagcccctgggaagggggtattaggaggaccaggaggggtttgagggcagcctggattgtatgaaatcttggcttaagaaactttgaaagcagacaaaacaattcccctaaaagacttgtgattgttaccaggggcaggaagagcaatggtgacacacattgtatggtgtcagtctggaccttcaagggtcaaggatgctgagtagaccatgttccagtctgtgctggtctcttctcagatctgacaggagatgggccagtgaccctcacaaactctgaactctaacactcacatcagagagcaggaacaaaagcaggaagcccaaggccatcacatacactctgtgtcatctccagcaagacactgctcttctgctcaacctacctgtcacccagggcctcctctttcataaggggttctttctagtgggtggaggacagtatcctgtacctactctgtcttggcaaaggaagcacagagtactcatataacccccgggagaagggggtcatagctatattatattacatgttaaattatattatacattatattagaggaaatgcagagtggtaacggtagtcttcctaagattcacagcagcaaaggctggggctgtgtgccctggtacaatgtgtgtttagtatgtttgaggctctaggtttgaacttcagcaccaataagtagataaataaagcctcagctcaaaagcctagaacagcagccactgctatgaggtctccccccaaatggatcatccttgtcccatccttgttactcaaatttaagtccaatggctgcacactgctcacagagaatcaacctccaactacactggaagggtcaggacacggcctcagataagatggctggcaacaagagaaatgtacactttcttgtagaatctgaagtcctggtccccaatccccagcacactctggaaccttgatttgagaccccatctttgggtaacctgcttagcttatgagaccccatctttaggtaatctgcttagcttagtaacaggagtcccacatagagctaaggagtgcttccctttcaagggacgagtctggcaccaaaagcttaaaactaactgtggtccattttgggctccaaatatcctggggctcagctccttcttccatattcaaagggacagactctcatctcttctttttctccatttagcataggagaggcagacacatggtctagcctcagaaggggaatactggaatctctctccaggaatcacaaagttgcctctgttcacataaggggactcagggatgcctgggcatcctcactccctggcctctgggagggagtgattccaaacatctggggcacgtctgagaggcgatgaggaccataaaaaaaccttgaggaaacaggactgtatggtagctatgctatgtctatggttgagggcattcaggaatgggcagagctaaacagcagtgggcttcccagggataggtttagtcagagaacaagatgtgatggggacttcaagttggggtacagctgagccagcagggccagggtggcagagagctgagatccctgggggtacagagaaagacaaagaagatgggcagattaggatgggggaggggcagaggtggaaaaggaaatagagactaaaagagggcggggaatggagggagggagagagaggagggctctcaggaaggaagcctcaggccccaggaaatggagcctcccctggcaactccaaccggagagtagcataccctggaggatgtggtcacctagttttgtcttgacctagcctgtctccagccatgtgaccctgagccttggactttactcctgtgagcttcagtttcctcaaccagagaaggaaagcactccattgcgagctgctagattgaaaaggcagagagggctgtgctttccccacctccacaagcgtctcatgccctgccctttggttccaacctagtctaggttagctgcttctcgctggatggctggcaggagcttcgccatgccccctaactctatcctcccagaatgtggctctcctgacactgtattccccctaagcacgtccctccctcaccccagtgtgtgtgctctttgaaggtacagacaatctgggggcacacaggtgcttacggtgcaggggtgaattcagcttcttttccgcagcaagtttctgctgactataattatgaggcagtttgaaaggcaggctcctagtaattcctgtttcctgccagagacaatagtgtctcttcattccaaacaggtgagactgggtcctctggaattccctgcaaggagtccagcccctgggcagtgttccccagctggccagcctcaacaagccaccatgtccctgggaaggtaatgaggcatctgtgaatgacaaaccatcggccagagagctctgttgttgcagcaaaggcaactgccatagccaagatggccccgctcccttccagccacctgcctggccgccacccggtccccagagaggaaattatcactatgcagagcttccacagcaaaacacaaacacctggttgcctgggcagcaccttgccagggtgacaagatccagatggtcccttgagagatagtagggttgccacggaaacagaatcgctgccgctctagccgagagatctggattctagatgtactggaccccaagctgagagaattgaggtgattttcataaagctacatcagtaggtttccagcttgaaccacaaagcaaagtcctagccagtgttgtaagttataacttataagtttataagtgatcggtactctggtgtccagtgttttgggagatgcccccttccgtggcataattcgtacctaaagtctggggcttcaggataaggccggggtcaggaagatggtggggctaggctgctgcatcagcttgaccctgtagcccgagctggacccctgcccttggttttcttcactttgttttctcattctgagctttaagtggcctatgaacaagcctagctcagaagccactgggacctgatgaagatcaccggaaagtggcaaaagagggcctatggtcctgggccagcatctagtgtctaggacttagtttctgagcatcactgtgcacatacagagctgggcagctcagagaaggcagaggtgccacgggggcacttcctcctagacacagtgactgatcccagggagggagaaagaagaggtggagccaggggagaggagagagagtgctgtgcctggagtcagctggctaaagctataccctcttctgcactggcttcttcctcctgttcttcagttgtaagggactacctgtgctgagtgccacccccatcccctccatcatcccttgccttgttatccgttcgtccacttgccgagtccctgcaatgggttgggtgggattgtgatgatcagccccaagattaataaaagcaacctgcacagcaccagacaagagctccatgaatgtcactgcctccttgcttccaatcctaagttctgaggatgttgtgggacacctgtggacacagctctgcctcccacaccaggctcagcctcctggtcatgaagagaggagatacacactgaacttcatggaaatccgtagcccaggcctctctggacttggtgtcatagggagtgcccactcttatgcctggtatttagtccccctgacctccagatgggtgaagctagcattaacttgcaaccgatgcaaacaggtcctttgctcttcagcccccagctttgtgttccccctaaggatgctaggtaccccaggagactggatttcagcatgctgggtaaatttgctaacacatagccatcaccaaacaataaggctttgttctaagcatcctgtgcagactgatcagctcaaaacctatgacctcaaatacacacaaaggttggtgacttttccaaggttacacagttagtaagtagggggctgcgtggcattcagagccaggcggactgcttctgagcctgcacgtttaactgtttctcttctctctgcactagtttagtaattgttagagttcttgacgtcaattagggccagcccagactctctgtgcctcaccctttgagtatcaaaggaccccaaagatgggaaggtgtctaacttacagcagagacaaagtgcaggccacatggatagcttgagtcattagcattttttattgtttattatttgtttgtgtagcccaggttggccttgaacttattatcctccagctggcccatattccttgttctttacatttatggtatttctttgtgtctatgtgagggtgtgtacacacatacatgtgggggtcagaggacgacatgcagcagttggttttctccatgtaccatgtcggctccagggatggaactcaggttgctaggcttagtgacaggtacctttatccactcagtcatcatgccttataaccactgtccgctccctcgcctccagacctgagtgtgtgtgtgtctgtctgtctgtctgtctgtctgtctctaggatctcactatgtagccctgctgacctgaaactctcttcacagatcaagctggtctcaaactcagagatttgcttctgcctcctgagagcagggttatagatttattttgtttttggttcttctcaacagggtgtcactatatagatctggctgtcctggaactcactgtgtagaccaggctggtctcatggatctgcctgcctctgcctcctgagtgctgggattaaccatgtctgccaccattttttttttaaatctctctgtctctgtctctctttctttctgtataatatgtgtggttatatgtgtgtaaccataacatgcatgttatagcacacacatggaggtcagagaacattcttaaatggtgctctttgcctttcacctcatttgagaaactgcaatatcacaagcttccaggttactcttgtcttgatctcccatcttgtaccaggaacacttggattacagacaagtgttgctctgctcatctgtatgtggctgctgggaattagaattcaggttttcattttctcttagcaagtgatacttcaggagccatctcctaaacctccctcccttttttttttttttaaataaagatttatttattattgtacactgtagctgtcctcagacactccagaagaaggcgccaccttctcctgatcttgttacggatggttgtgagccaccatatggttgctgggaattgaactcatgaccttcagaagagcagtcagtgttcttaaccgctgagccatctctccagccccaatctccctcctttttaagacaaggtttcatacaaccccggccaaccccggctggcctcaatcaagtatttactttgctgagactggccttgaactcctgaccttcctgcattagcatcccaaaggctgggattacaagtattcactaccacacccaacagatattgcttgagtcacagatctgtctcacattagttaacctttctcaactgcaaccggctcacctacaccaggcaatgggtgcgaaccgctggggtcaggacaagggatgaatggcgactgcccactgatctaaggtttgctgtgttgtggctgaaaggggatataaactagattttctcctaatccagatgccctttcctgacctaccctggctgtaaatctaaacaggcaagatagataataactgctgattcttgtctgtctcttccagaaggtatttacgagactgtcggcttgcaacactcggagaaaaagttcccatactaacttgctcactgcctggcaagccctggatccatttctccctcctgtcctggagtccctgagaatccctcctctcggtgagaatgcaaagcctgccttaagatcaaagccctggcttacttgatcctctcacctgctcttcctttttagcactattggctgtggttggctttattaagctctacctccttgaggtaccagggaacatcagaggggggctgtttggcaggacctctgtcctgagaacacctttgtgttgggaagctgggggctggtatagaaaggagtcacccatagggtgacagtgcttttggttctgctttctcagagcaatgttctagcttcttgggccccttacatcctgcagagaagcaaagatggcctggctggagttctggtcttacttctgtccctgatacccagagaacttgtttttgccttcaagcctgccttggggattcttggagtgggacctgcagtctggtaaacagctgtggtgggtgtggtgctccttctgtcacccacagagtagaagcattcatttatttcaaacctcaatagcttgggtgctctctctctctctgtgtctctgtctctctctctgcatcttcagcctgtgctttcagtgggaccggcactggaatcccatcagtctttcctgtttggtatttttcatgctgagcagcaccgagcatcccctgactcttcctccctcttgcacccgtgaaatggtgcagatgccttagatggtgggggaacttgaggctggatggaataagtgtccatcatccacaggtcatgacccacaggatggctcacagggctccaggcccccacaagaaaactattgttcaacggagactcaggaagtggctttcatcgtcttgacagtttctgaatgtggcaaggggtggctactctactgggataagtagttctctaggcagtggcatctagttctttttttacaaccccctgtgtagaagccaaatgaataaagcaaaactctcagtatgcagtcataatttgtctagcctggagcctgtccaggagatgagaaggctgcaggggactgtggcagggacagtcccacgctaggcaccgtgagcgccttatctgctctctgccacgcagcacacactgacctagcacgtggcttttgcccctaggcagagctacctgtgtgttggaaggctagcccatcctctccatccctcaccccagacagccctcaagtaaggatggagaagggactaagcgatggtgactaagtacttcttctgtggctcctcactggtgagagtgagggggtgagtaacagagccgcaggcaggctgagccccaggagcccatggcacataccatgcctaacagccacacttcgctgcggtctctccctctcacccatgctcctacttctctacagtttagctggagccttgacctcccccaccacacacatcctggatcccttcccctctactcgcaggcgccagtgcttggacttctatgcagaaagctcaagccctgcatcatctggtagggtcacagctgcagatgtagacacctcctaccgtgggtggatgccctcatcccctccctatccccttcagcctcttggtttggatgggcttagaaagtagacacctggctgagccccaggcagccctggccttgcacaagtctctctcgtagggcggggagagatgagctaattctgtgagaggcaggaagaatggccttctgacaagaagaggcctgtcccctctggctcttggggcactattgcaagctgcctgtatagagaaacagctgagccgcctaggagttgcttctgttctgaacacccctaacaactccaatgagctccgaaggaatagagggaagggtgggaacacacccacctcctttgtagttgatagatcttgtaagtcaatattttgggacagtgcttattttctgtgcctagtgtactcaagggcagcttctgtacctgacaactctaaaactaactaactaactaactaactaactaactaactaactctctctctctttcacacacacgcatacacacacacttacatgctttctccctgtctctgctacctctgtctctgtctctctctctcactctctcacacacacattcctaaataaataaaaacaatctgctcagtctatatagtgctacttatacagatgttttgagggctgaccacttagtgttggacggccattcggtatgctcttccttggtaagctggttggtgtttttaaaaggttaacctgacgacatcccaggcattcccacatggcccttgtttttagtggccactgtggccatggagaaactcagccctttccctgagtgcaatgctcttcccacatctgcctgctttctaacacagctctgcctcttctccaaagtgaggttttaataccctggggatcatccaactgccctcccccccagttccttagcctgggaatgctgggcccacaagtttcctcccactggtcctctttgttgaagagcagagcaaggttacaggagcccatggcacagccctcagcgagatgggagttgggggaaccagggtcattgccccagtcttcctgggtcactcaggaggagggatagcttcctggggcccaaactggactcgctttcaagcaaattctgtcactagcactgagaactatagggctggagtctgtctgtccctctcagagcctcgatttcctcctctgtaaatgggtgtgctaacaacagagccccagtgacctctcccatggcacagagaacacaggttttggccacaacacatatctgatggttagtcagttcccacaggctggcagtaaaatccagagccatttccatgggatctggcctgggaggggcagaaggccctgcagaaggaaggaagccaagccctcccccacagcccagctctgcagagttcacatgggggtgggggtggggatggtgtccaggaggaagtctgtcccctggccttgagaaggtgccccagcctgccaggcaggctggtgtttcaaggacaaggccttgccttcctgctatctctgggggaactggcagccactaacaaatcccctgcaatctgcacccaccaatcctgcctgctcgctgggcagccgagagccgtttttcacggggagctgcacacagctttgtcttagagagacagctctggcgggtgcccctgaatggggctatttgtcctccatgctgaagggaaggcagctgaatgctctgttggggtgggcagaggcagagagggtggagaaaggctatgggggagggtgaaggtagagatagcagccacgacactatgagagaccagaagtgctgtccaccacggaggtgtctcagagtcaccatgcagctcggtgagtgcaaaaaaaaaccttgtttccacagcaatgggacactggtatatgaccggccttccctagtgtaaagagccctggctggtagaagttgaaatgacctgactggttttgggtgcctttgtcccatcccagccccacgacaaattaactacggggctgccacactagtgccgtagaaggccccattccagcccctatccctgaactgagagctctagagtgagacccagtatctcttaagagcctcttccacagatcacaggcagagagaggcaaggcatgtctcagtgtctccactaagaccagctgacatctgacaggcacatgactcattagggaaacagagcaggcatgcatctggggacttaaagccagcaagcgacattatttccactcccgttctgggacctgggctgctgtactggaaggtgtgcttagaacagaggtcagaggtcagagaacccagtagactttacccatcttggggatgcagacccaaggtttccattcaaaggatgcagaacatctgcgtgatggtgctactccacgaagagcaagtaagtgcacataactaacaggcatgtcctaaaaccacacagcagtcccacgtccacagccagctctgggcagcctggctgtgttaagattggcaaacaccctctgcctgtccccacttgaatcattcctctgcctcctgtggtcccttctccaaaagcttggctggtgcctgtcaggatggcctgggtattcttgatgcctcccacagtagctgggtgcctattctaccaatagtccctttaaaccacccaagcatccaagcattggctatgccagggagaagaaagaagacaaaaaaaaaaaaaaaaaaaaaaagcagctggcacccccacctgtgccccagccccattatggatagcttggggcgcatcttcctttcctttggtccctgggctgcttaccttctgggctctgacattctctattctgctatttcaacatgtgctggctgctcagagggtcagctgaggctacatagatctattcaagcatagacaccagcggaggcatgcaggcaactcttggggaccctcggacatggcgactgcctggtttctcgctcccatgtaggctgaacagaaggctgaaccactgagtgagcgcccaagaggctgacattacagtacagcctgccaagttactctgggctggcatgcggtggtggagggggctgatgggcattgctacagccttggaggagagcctgggatgtgtcaggtgctgggggctgggcaggtgaccttctatctaggaaggggtggggggtgtgggagggtgcagccggcccctcaggagcctcaagatgaggatgcaagtgcatgtgcgcatgcgtgctcctgctcccgtgcgcgcagaggctaaaggctgcagcagaacaaagagttgggggctgggcatcagagggccccacgtggaggcggctgcctgggcggcttgctgtagtgtctgggctgtgctcagctctgcattccgtctctgtctctctcattttcgtgccatacagtgctgcccccaggcctgagcctgctcaccgtcaccaccctgctcactgccacaaccacgcacacagcccaactctttggtagcattcttgacaaagcatctcccctcacagcatgatctcattgcagggccttctcaggccccagcctggcctcctgacaggcgagacagaaggcagaagggtgggagaggcgcccatagatgcagctagttgcgcgtgcacacactgctcagccattccgtaacagtcatacaccacccccagaacccacacacatctgtgaacacctataggtctctgtgcactgaaacccctccaccatcacaggactcctcaggtacatgtgttcatactcaacagtcagacataccaggcatgagcatacacgagtatgcaaacagacagacagacatgtgcatgtgcatgacatacagccacacacacagagatgcagaccttgtacacacatacccatacagtcagacataccaggcatgaacatatatgatcatgcaaacacacatatatacatacatatacacattacatacatatgtacataaatacacacataatacaatgtacacatgcatggccacacacagaccatgtacatacccacacagccagaaataccaggcatgaatacacagggagatggccttgaacacacttatagcactccacactcacaatgcacacatgcacgatacttatagcactcgacactcacaatgcacacaggcacgatccacagccacgagacgcacatacttcacataaagacacacatgcatgcacagccatacacatgtagagccacatgtacccagtgtggggttaaagtctgagagcaaggaaactcggaaagtcacagaaagtcaaggaagatagatatggccaagaataatgaggaagggacagtcagcagaggccctcagggaggaaggacagcaacactgcacaggcaactagacaaagtggagtctaggcaaatggggcagacggggggggggggagcagctggggtgccatagtctctgagcacagagtgccaggaccaaggcctcttgggagacttaggaaagccatgtgcaccagaagggcaggttacatctggtcatggacccacttatccacagagctaagggggagtgatgtgcattttgggcggaaaggaggggtcaggagatgtgttgcagacagacacacggagaacgacggctggaaagtggcatgtgctggtgtccaccatgtcaagtaccacctgggcatctttcctggcccacattgagagagccagccctctgagttcccagaggcatctgtgcaccagggctgcaagcctccaaccacaggtctgagccaggcaaggtggctgagagatcaaccttgggcccagcaagcccctcatcccttgaaagaaaccagctgagagcctgcagcctatcaagcagggatgcccttacacacctagggaagctggcgagtcaggactgttgggtctgaggggtctgacaggtctgcctcctaacaaggggacattccacttctgccaaggcacaggcatgctggcttaccagctgacaaaggagttacatggacaaaggaacaaacggacgacactttgccttaggcccagcacgggaaggggtgctgtgaactgtgaccttgcccagctgtgacgcagacagggagaacaaacctgagtgtcagaatcagaatgctgaaaatggctcttggaaagtgcagcatcctgctgccgtgccaagcgagaggatgcttggatcctagacaggagtcagctgagatggagcaggcaaagccctcagaggaggctgcagtcccggttccagctggatcgtttgttagctgtgtgaccgcagacaacccccaagacttttctgaacttcagtggcctcatccgtaaatgtagataatattctgtgcctcacaaagctgaggtttactgtgctttagagactattgtatgagccattgggagaggggtttaaaagacccagaggtcaggtttcacagggcatgaggcttccccctgtaccaaggactacttctggcttccagaatgcccattctcccattggccttgtctctctttgcctacatgatctttcttgactttgcctattatctacctatctatctacccatctatccatcatccatccatccatccatccacctattcatccatccatccacccacctacctatctacccatctatctatatccgtatggaacccagggtctcatagatgctaggtgtcctggttagttttctatcagcttgacataggtggggtcatctgagaagacagaactgcacttgagactatgcctccatcagattggcctctggcaagtctgcgggacattttcctgactaatgattgatgtgggagggcccaggtcactgtgggtggtgccaaccccaggcaggtggtcctggattgcataaataaaccaactgagcaagccacgagaagcaagccaataagcagcattactccatggtctttgcttcagttcctgcctccaggtttctgccttgagtcagccctgactttccttcctgatggaatagggttatctgtagatggaaataaatcctttactctccacgttgctttggatcatggaagtttatcacagcaataaaaaacagcaaagacactagacaagcatcttaccactatgccatgccccagtggcctccttagagacatgacactgtcccctatgtccacactgatctctggcctataaagttattctttgtgctagcagagatgggatgtcatagcctgggattttagccatgttcccattacctttaggacagagaacacaacctttaagacagggtctacatgattcagctgccgttggcttcagcagcctccctctggccctgtgctcttgcctctaggtttcagaactaccgtccttgttttaattctgacacaaagccctgtcctcttcccactcaaggacctttgcacatcgtgctcctttcacctgtgaaggaattgtcacacattcaactcttgctcaactttgggaagcttcccttgaccctgctccgagccttccttcacagcactgagtacggcctgaacctgcagacacttcaacaagcgtgtactctccatgtgcatgcatgtgcacaccccccccacacacacacattacagtcatctgtccacttagtccgaagcaatcaagagtgttagtcgtcctgacccactctccatgctttacgtgtttctagaacttaccacgacccctgcaaggcaagtctcattattcctactttcccaaggaagtcaaactgaggcctagagatcacagctagcaagggcactcccaacagtcagttgtctgtgttttttaaaatccaaatggatccactgtctacacatatttatgaggcaggtgtaaaagtggatcattaagaaagcaaacaaacagaaaaatggagatgggagtccatctttttttgcccaggttgcccccaaatcccagtaactctaatgtgttcccttcaaaacagaatgcaggctaggaccttcccagacctctgtcaacacggactcaggaccccttgctgtggccacgtctcaatagacaatgttttgcagaagacatttttttttttttagaaatgctagattgacaggttctgttttgtttttgagtgggttttgaatgaatgagtaaatgaatgaatgaatgaatgaatgaatgagtgaatggtgggcaaggatcactgtgcatactaactgcaatactgacctgactatgtataactccatgaccaggaaaacctcttctgcttccctaaacctcactgtcctcactggtgcaattggatagataacacaaggcattcgccaagtgcccacagcagtgatggcacgtgaagatgcttgacctgcctttaggtcagtgcctgtgctggggtgtaacaaatctgagtgttgtccctctgctgggagacacccagggctgagccctatctgtaagccatagagctgatcacccttggaggcttgcaccgcccctagaccaaacaaggctcctcccaccttctgcatccacctgtcaagccccagacaggtcagtacttaccagcagacttgggggtgaacttgtctcgatttgcggcgcacacagccaagagtctgtagcccaggtccaggtcaaacccttgttgggcagccacacggctgacaacctgacagcaggaagaggaaatccagggtgagttaccattccctcagagctgagcctgagtaggtacacatacccacaacaataatgaagcaggcaaaggcgccaggctgtggcaggggtcaaaggccagatggagttaggattctagcatgtctctttgaatggcttgaatgatgacctagctaggcattagcttgacatgtagtaccgccttcgctagagtggctccagctaggtgcttgcatcaccccatagctgctcaccttacctgagtcctagccccaggatgcttctcttccctcggcctcctgccactatgtctgggcttctgttcctacctcagcaggtactcactacctctgctgctcccaggcaccagcatattttggggtatctcctggagatgtcctgcatcccctactctcctgcatcaacagccataccctgagaagcagagacttgggatttgctgctcttccagtagtttacaggcagagttgcctatagaatggcaaaggcccctggaccaggtggacaggtgaaccctgtactctggagctcagccgggggtctgacttggcactaagtccttagagtaagcccctaaatcttactcatctggagagataggtgccttgttggggtactgtgtggaactggggtgccccaaggaccaaagagaggcccgggaggctcctgcatctgattctgtcccaagaagacctatccctgggtgaccaggtctgtactcccatctcattaacaatggccagacaatgcttccttgttaaggagggaggagcttagaaaatgcactcacccaggagagccactggggaagccaaggctgagtgggaggctgctcccttccagctgctgaggaagggaggctgaaccctcaggcctctgggctctgccctacttggatgctgttgaggggcctcaggctgcagagggtttagggccatccagggccatcacaatagcatcccacttagggtgggggagggctcaccacaagggttctatgactgaaagggaaaatcctttcaaccaagcctgtgaggccagctctccttttcctctccttgcatcccattctctctctctctctttggaagggtaccactgtgcagcccagtctggcttcccaacttgtgatcctttcgagtgctgagactgcagatgtaccaccatgcctggctccatctcctgtttttaactgaagggacacagaaggtcaggagtgtaacagaatgagggaggagggagcagagtgtcctttcccagtacctgccagaccagagctctagacccctgtcctggaaaacccctgcaggcccaaagccagctgggatgggaggaagcagctaatctcacttggggatgttttctcggtttcagatgcaaagagaatccttccatgctccccagactctttcccatgggctccctggctctgtttgctctcaagtctttagcccagtagaatggagcttccttaccggctgcctcagccttgatccctaataggatctggcctgtggaggtttccaagtttctagtcagggactcaggggagtgggggaaggttctggactttctgagctgcagcttagatgctgccttcggtgttttccgtttcgaagcacccgggagctcagccattggggtcactgtgtctgactggtgcaatgctaagggttatgccggcccaagaaacagtaggtctgctgtggccaagtctggcatgctttgggcacaagttgtcttttgttgcttaaagaaaggggctttgctcaagatcatatagcaaagatatgacagagcaagcaagccagagcatgtgacactacacagcctcacgtgctgcccagcccttggctgagtctgagcccccatgaaggtctcataaggtatggtccttttggccattggtaaggtatattggtaaaatgggcagattatatctcagacaggcctgttgtatcccagggtcctgtagttggcctagactggatacatgctagaaaccagctcatctaaggccgtccttctaggcatggctggcaggaacctagacgttaagaggggcggctggcagggtgtttagtttcaatacttcagaaggtgaaactattgtcccagagacaagacttgcttacagtatcacagggtgctgcagcagctgctgcgtctctgaagttagggatgaatctggggtgtgcatgtgcccctcacagtcatctcaagtgactatctactccctgggcctcagttccttcacctgtgaaacggggacaaatgttcttatgactagtagattggagtgagtccagacaggcctccaagggttgattgaggtggccagtggcctagagactcatatttgagttgactctgggcagcttagaagttggtggcaaaacaaacagacaaacacaaaccaaaccaaacaaaaaaaaccctaaaaatcaaaaccaaaccaacaacaacaaaaccctccacacccatttgttctttgcagctgagtggtttttaatttatatcctcaaaataagccgatctggaggaatttagaactagctaccagaggtcaccgagggaactgtgtcaacctgcaggcttagctacccaaggctagcgagggacccaagcctgcagagtgtgtgtgtgtgtgtgtgtgtgtgtgtgtgtgtgtgtgtgtgcgtgtgtgtgctggggagggcttagcctctcctgccctgcagtcgtctcttcctgcaggaaacactgaggtaaagatagtaacttcctactctgcctatgctgttcacttgcaggacagagtcccacaactactttgcacttggacacaactctcagtctcccgcttctttgctaccagagcctgtcccttccagctgacaccttggctctgttctcctaacaaggccttctgagttcctattgtgtttcatggctactgtggtggcccacagcagggagtaggtaaatgtctgctgaacgactaagtgaacgacaagcaagacaggactagcctctggtccatccacggtggccagggccagtgtcccccttgagtgcatgatgtaggcagggccaagcctggggcagtatgctggagtagcatattagtttgtttagcaacatcctgtgcatggccccagcccctcttcccactacagttacaggaaactggggtgggaactgtggcctaggcaacatctggccctctccatggggcttaggctgggcccagatcctgcaaagaggattagacagctgggcggagaggggagcttggggactgaaggataaggaagacagggccacgcaggtggcttgagtgagacagatggggccagcttctaatagactaaccctgggaggctctgtgccatgttttagatggactggaacaccccctttaggttcacatgggcctcagctagagaccaagatgcttttaagactgggtggcatggcagtcagttctgagtctttgtgtcttcctctgtaaaatagaaagcttgaaagacaggtggattctgggaggaggcacatgccacaagcatttcagcctttctcagaacaagatagcctaatgtggtcatcatgtctcctcttctaaaccagagctaagctcggttctttgtccctctcctgtctggagcaccttaggagacaacattcctgcctggccctgcatctctagcctacattccacactcaggacacgcaggctccacacagtgtgattcacactcccttctaagcccactacaggtcttctgaggaactgtcctaatgcaggccacatggctgggggacatttaaaagctacagaagactcccaggttctttctagcctcaagttcgggcaggttcaatatcctgtctagtctggacccagttctctggacaccaggggcctttgcacacgctgctttgtggcccagggacactctggctgtgctcagcaacctggtaagttgtgtcatatgtaggcgtggttttacatgactagccccacctcccagctggcaaagagtcacaccccgctcctgtcacctgtactgttattctcagacattcctccacattgctgctccttactaagaaatcaagcttaagaaagttttttttttttttttttttttttttttttatcttggggttatccaggacttggcagaggggaccacaagtgataaatgagggatcaatcaaggtctatttgtccagacggatgaatgtcacaggggctctatacctgctcttgagtggacagacagacaaccagagcgaagctcaataaatgctcagccgataaaggaataaatggccttgggaaaagaaggctgagtcctccgagctcccctgcctctgagggagcactggtcccccactgtgtgcttctcatcaagtgtgaggaagccacacatcccataaagacggtctccatatcagacctggcagtggggttgtgtgctcctgcagggccagcttgcagcatgggcagctgttcccccagcatttggggcccacagaaaggtatgtgggcaggacttctgaccccagggccatgcttcccagtgtgctatgaaggggaagttgaagactcaccgtcaggcagcccatgaggctctgctcaaagggcctctggaaggctcgagggtctccacaccaatccagcagctctgtagcagcattgtggaagttggcggggttctgtaagtgctgtggagaaaaaaagagaaagacttgaggctgcaagaagaggtcagggaacagaggagcacaggactagccaggaaggagacacacagaaagaaggggcagaaggctggtgggattctccagctttctcaaacaccctctatgcaaagcctggcccatggcagcagatgagaccagcggacctatttccgggatgagaatcagggctagtaaaggccagagccatcagacatccaggtgctctgtggatgcaggtggctggggaggggtcccagggggattttagaaggtggtacccgtctctatacttgcggccagcaggctgtggcggtgtcttcctaacaacccaccccctcaccctctactccagctctggtcctccctgtgtgtgtctgaggaggaggacaccctgggaagggagacgtggtctacatgctgtctataggatggtgtgtgtggcttagtgttcttagcttcaaaggccagctcctcaggtcttgatctgagcccttttggagcctcttcctcatgcctcacacataggaaagtcagaatcctggggctttcagagatacttgaggccccaggctgccagcatggaggagttgacgagatctcacttcatcctttatatggaccctcagcttcctgggtccttgtcatttggcactgggaccaggagagagaagaccagggctgtggggcaagttagagccacagctgcgatttgacctagtggtaggtatgagcccagaggttatcatgtagaaaccagattcatgcatacaggatgctagcagctccaggccccttggtattggtaggatagcaggatctcactggcctagatgggccctgtaactcctctgtggcatgagtcaattcacagccagggcagagtgggtcttggggttggcgccccagaatgaggctgtgggagcccttctggggttagggttctggggtcactcactctgcctgtgccccttattaatctaggatggtcctttcacctctcccatcctcagtcacccatctgtaagatggggttgggagactcccatgtggtcatgggaattttggttccttgtgcttatcagagtatggttcgtgcatggaaacgcttgcagcgagaagcaagtgagctcaaaaaaaaaccccctctccacgaagaagagacagagggagaaaaaagggcaagcgagcagtaacagcctgtgtcatgggggtcagatgacaattaaacaagaccagctgggcttgtgtggtccaggcacagcacctggcaggtagcatggttccaccggcagctgccctgggctcagggttagggttaggtctcagcctttcagaggctccccacctcctctgcaggagcccagcagctctcccgcttggctctctaaagctgcagctccttgatcaccaagccagggaggggccgctgcatacatagccacgcccttggggaggatggctgcttggcttctgcttctggtgttcacttctaaatctgcctttcagaggccccagggagcactggggctctgatggagcgttgcagctcaactcagcagctccttctggcttgcgctcccctgacaaccaggtgtttcatttatttatgtgatgccacgaccaatcagcatggccagcaagccgcacatgcacctactctcaggtgaccatagcaatgctctttggagacctgagctcctgagtggcctctgaggctgatcccccaagcc

SEQ ID NO: 1602 - DNA, 3500 bp, Mus musculus
cgagcggcggcggcggcgggcgcccgggagagcaagctgccggccgggcgagcagcgatccggctgcagagcaagcgagcagcgcccgcgcagcgcgctgaccctagccccggccggtgaggagccggagccggagtcggagccgagtggatttccgcgctctcgctgcgctcctcccggctccagcctgccctacacggcggtggcggcggcgcgtcctccagcggtggcagtggtgctcgcagcgcccggactcagacagcatagaatctactcagcatctccttcgccacagcctcccttccccaacatcacattagccttgagttgtgatcgactggcaggagccctagcaggaggatggaccttgagtgaagtggaagagctgctggaccacgttcatggctctcgggtaggacccagcgaaacggccagaatgaattctatggacaggcacatccagcagaccaatgaccgtctgcagtgcatcaagcagcacttacagaaccccgccaacttccacaatgctgctacagagctgctggattggtgtggagaccctcgagccttccagaggccctttgagcagagcctcatgggctgcctgacggttgtcagccgtgtggctgcccaacaagggtttgacctggacctgggctacagactcttggctgtgtgcgccgcaaatcgagacaagttcacccccaagtctgctgccctgctgtcctcctggtgtgaagaacttggccgcctgctgctgctgcgacatcagaagagccgccagaacgacccccctgggaaactgcccatgcagccccccctcagctccatgagctccatgaaacccactctgtcgcacagtgatgggtcatttccttatgactctgtcccttggcagcagaacaccaatcagcctcccggctccctctccgtggtcaccacggtgtggggagtgaccaacacatcccagagtcaggtcctcgggaaccctatggccaatgccaacaaccctatgaatccaggtggcaaccccatggcatcaggcatgagcaccagcaaccccggcatcaactccccacagttcgcagggcaacagcaacagttctccaccaaagctggccctgcacagccctatatccagcccaacatgtacggccgacctggctaccctggtagcgggggctttggggccagcctgaaccctgccggcatggcagctggcatgacaccctcgggcatgagcggccctcccatgggcatgaaccagccccgaccacccggcatcagcccctttggcacacacgggcaaaggatgccccagcagacctacccaggcccccggccccagtcccttcctattcagagcataaagaggccatacccgggagagcccaactatggaaaccagcaatatggaccaaacagccagttccccacccagccaggccagtaccctacccctaaccccccaaggccactcacatctcccaactaccctggacaaaggatgccgagccaacccagcaccggacagtacccaccccccacagtcaacatggggcagtattacaagccagaacagtttaatggacagaacaacaccttctcctccggaagcagctacagcagctacagccaagggagcgtcaacaggtgcagctgctgcagcagcggccgctggatgggtgaagtcagcaggaggccgagtatgtggagggatgcccatgcctgctggggcactaggacccccagggtaactgtcaagcggaatttcagcagtgtggctgcctcctcgggcaacacaactctcaatggggaggatggcgtggagcagaccgccatcaaggtgtctctgaagtgccccatcacattccggcgcatacagctgcctgctcgaggccacgattgcaagcatgtgcagtgctttgacctggagtcatacctccaactgaattgtgagcgagggacctggaggtgtcccgtgtgcaataaaactgctctgctcgagggtctggaagtggatcagtacatgtgggggatcctgaacgccatccaacactccgagtttgaagaggtcaccattgaccccacgtgcagctggcggccagtacccatcaagtcagacctccacatcaaggatgaccccgatggcatcccctcaaagcggttcaaaaccatgagccccagccagatgatcatgcccaatgtcatggagatgatcgccgctctgggccctggcccgtctccctaccccctcccacctcctcctgggggcaccagctccaacgactacagcagccaaggaaacaactaccagggtcatggcaactttgacttcccccatgggaatcccggagggacatccatgaacgacttcatgcacggtcccccccagctctcgcacccaccggacatgcccaacaacatggccgccctcgagaaacccctcagtcaccccatgcaggaaactcctccccggcagccaccacaggccgctcccggcaaccatccacacagcgacctgacctttaacccctcctcagccttagagggtcaggccggagcacagggagcatccgacatgccggaaccttcactggatctactgccggaactcacaaacccggatgagcttctttcctacctggacccccccgaccttccaagcaatagcaacgatgacctcctgtctctctttgagaacaactgaaggccactctccactggggccatccctccccactctgcctcctaccccatctgtcccacatcctattcctcccaggagcccatgctcaggcctcccacaccaggacctcaggctgagagctgagcagagcacactaggcagggaaagccatgtgggtctccagtcctgtttgcctgaatgctctgggatctatgcctagagcaagcctgaagacggcccctggaagacaaacccaagctgagggaatccaggcccagcaagagacatgccaatggcgactgtaggtccctccatgtgtgctgactccagacaaccgaccttccagtgtcccaaagttcttccatgtttttaaaccttatccccgcctcttggcccagagcctccttcagatgactggaacccgaaagaagcctgtgctccggcccccaggccagggtagtggacaagccttggaggagtggtgacagtttgcagcagtgaggaaggacacgcacacacacacacacacaccacagaaaagcacaaccctctggggaggagaccatccctcaaggccgggggtcgtggctttggcctctgacttctaagccaagatgccctgtaaacactctctcagcagaacaaggacaaagtgccgtgtctgagagagagtgccacaccttgtagggactggcaggaaacaggtcagggccttccccagagccaagacaatgcagaggagggctccttaactcagaccagggccatgccttgcggggagcagagagtgtgtgcaccacaccaaagggag

SEQ ID NO: 1603 - DNA, 2427 bp, Mus musculus
atggacaggcacatccagcagaccaatgaccgtctgcagtgcatcaagcagcacttacagaaccccgccaacttccacaatgctgctacagagctgctggattggtgtggagaccctcgagccttccagaggccctttgagcagagcctcatgggctgcctgacggttgtcagccgtgtggctgcccaacaagggtttgacctggacctgggctacagactcttggctgtgtgcgccgcaaatcgagacaagttcacccccaagtctgctgccctgctgtcctcctggtgtgaagaacttggccgcctgctgctgctgcgacatcagaagagccgccagaacgacccccctgggaaactgcccatgcagccccccctcagctccatgagctccatgaaacccactctgtcgcacagtgatgggtcatttccttatgactctgtcccttggcagcagaacaccaatcagcctcccggctccctctccgtggtcaccacggtgtggggagtgaccaacacatcccagagtcaggtcctcgggaaccctatggccaatgccaacaaccctatgaatccaggtggcaaccccatggcatcaggcatgagcaccagcaaccccggcatcaactccccacagttcgcagggcaacagcaacagttctccaccaaagctggccctgcacagccctatatccagcccaacatgtacggccgacctggctaccctggtagcgggggctttggggccagttaccctgggggtcctagtgccccagcaggcatgggcatcctgaaccctgccggcatggcagctggcatgacaccctcgggcatgagcggccctcccatgggcatgaaccagccccgaccacccggcatcagcccctttggcacacacgggcaaaggatgccccagcagacctacccaggcccccggccccagtcccttcctattcagagcataaagaggccatacccgggagagcccaactatggaaaccagcaatatggaccaaacagccagttccccacccagccaggccagtaccctacccctaaccccccaaggccactcacatctcccaactaccctggacaaaggatgccgagccaacccagcaccggacagtacccaccccccacagtcaacatggggcagtattacaagccagaacagtttaatggacagaacaacaccttctcctccggaagcagctacagcagctacagccaagggagcgtcaacaggtgcagctgctgcagcagcggccgctggatgggtgaagtcagcaggaggccgagtatgtggagggatgcccatgcctgctggggcactaggacccccagggtaactgtcaagcggaatttcagcagtgtggctgcctcctcgggcaacacaactctcaatggggaggatggcgtggagcagaccgccatcaaggtgtctctgaagtgccccatcacattccggcgcatacagctgcctgctcgaggccacgattgcaagcatgtgcagtgctttgacctggagtcatacctccaactgaattgtgagcgagggacctggaggtgtcccgtgtgcaataaaactgctctgctcgagggtctggaagtggatcagtacatgtgggggatcctgaacgccatccaacactccgagtttgaagaggtcaccattgaccccacgtgcagctggcggccagtacccatcaagtcagacctccacatcaaggatgaccccgatggcatcccctcaaagcggttcaaaaccatgagccccagccagatgatcatgcccaatgtcatggagatgatcgccgctctgggccctggcccgtctccctaccccctcccacctcctcctgggggcaccagctccaacgactacagcagccaaggaaacaactaccagggtcatggcaactttgacttcccccatgggaatcccggagggacatccatgaacgacttcatgcacggtcccccccagctctcgcacccaccggacatgcccaacaacatggccgccctcgagaaacccctcagtcaccccatgcaggaaactatgccccacgctggcagttctgaccagccccatccctccatacaacaaggtttgcacgtaccacaccccagcagccaggcagggcctccattacatcacagtggggctcctcctccttcccagcctccccggcagccaccacaggccgctcccggcaaccatccacacagcgacctgacctttaacccctcctcagccttagagggtcaggccggagcacagggagcatccgacatgccggaaccttcactggatctactgccggaactcacaaacccggatgagcttctttcctacctggacccccccgaccttccaagcaatagcaacgatgacctcctgtctctctttgagaacaactga

SEQ ID NO: 1604 - DNA, 94529 bp, Homo sapiens
ttgcacacaatctctgtccccaagaggatgggagtccagacaggagcaggaaatggggttgacatttctaatcctaccagttgctcaaaaccacattggaagtagttatcaccatccccactttacagataaggaaactgaggctcccaaaggtgttgtgagctccccgagggctcacagctctgagtcgcagggttgggattgagggccaggtcatgcggctccaaagtccacgctctttcaacaggcccacgttgcctctcagtctggcagggagataagccgtgtacacaaatagctgcaatcccaggtagaaagtgataagtgccaaacaggggcgataaaggctctgggaggggaggagactgcccactgcgggaggggctagggtgggggtcaggacaggcttcacagagtgggcagcatctctgcgcaagctaagacatgggtcgctgaatccacagtatctagcagtgtctgacattgtcacaggggcccaggaaatatttgtgaaagaaagagaggaaggaagggaggtgaagagggagagagaaaggcagaatgggagggtggctatgctctgaccccatttggcccaggaacttgctcctctcacaggaagacatagtcaagagctgccaccaattagagaaggccttcatggggtccccattgtcctgtgacaccccagagaagtagttcaggactttcaggccagagttcctgacaatcagatgttttgctcaataccagaaagaacttcccaatgagtaaagctagacaagacttctctgcggggcaggggaaatggtgtgttggagcctgttcatatggctcacaagggccgattgttaaattttcaggaactgcgcgagctggttgatggaaccaaccagctgtgccagctggctctggtcggcagcttgaaactggccatggtgggggtatttacaccgtagacatcggcaaatactacaaaccaggttctccccactttggggagccagctgttaaacatttaccagcacaccactggcagaggtctgctatgtgagggagcaagcagcccgtccctggaagagtacaagcaaagacagtctcctcctggcaggaacgaggctaaggggttctttcttagtgaagggctcagagcaaatgatctcagaagccctgttctggctctaagagcctaggaaaagtcgggtttaagaaaaaaaactaaatcaggataattcatgccgggaaatcatgaaccactagacccagagactgggagtagggaagagacctgagaaaatgtgtgaggggccacatgcttggatttctcaggtggaaaactcggtccaaggtgacatggagagtcaggggcaatgctaggactagaacttatgtctctggctgcccatctcacggttccttctaggacatatgggctgggcaactaggaagagggggatctttctgcacgaagtctggtgtctgtctcagaatataagctctgcagcagtgtggaccaaatctgttttgttcactgttggagatctggcatacagcaagtatttaataaatattccttaaaggaatcgatgtgtctgagatcctgtctcctggcagcatttggtcgggtggaggtggtgggggctgggaatgtcatcctctgacaccgtcacttcctgagtccccactgcagcttagtgacatggaatcaagagaccagggttcaaatcccaactctgtcacctcctttgaccttggccaaaccattatgcctcctgaacccttagtttattcttctacgaagtgggttagcaatccctgcctgcctcttgaggctgctgtggcacttgcgtgagacgtcaagtactttttacaaactaaagagctgtgtccacaggaggaagggggtgccaggagagctggctgtggtggcagtgccaacccaagggtccctggtggacactggacagtggccaggatgctgctctcttagaactgctgcttggggtaatctgggtcaaactagccaatagcctgtggagaggaggtctgagtaccagacagctcacgaaaggggcaggaagcagaggatgaaatgaagatggtaagggagagttggagaagtcctttttcctcctaagaccaaaggcagaaggcaaactagcaacttaaaaaactgtttttgtctctgtagagctgttcatcatgttcccctttcccccacaagaccttcactattgcaagaggccttaatgtgtgagctgaggactggcacctgccaagtcaggtgggggtggggtggaaaatcctcatatgtcctagaatcagaccagtgtttcaaacgattttggaagagggatttgtgtcgctctcccagacaagcatcccaagtcccctcctggtagggtgggaggacaggctggcggggagggaggcccagcgcaccccaggctgtgagtggatgaagaaggaaagcagggggtgggggtgctcctccaaccctcccccaagtgccatctgatttttgcaaagagggtgaaggcagcaggaggctcagagccagggccagggaggcaggtggagagggtgtccgtggaggggctgcaccgtcagcctgggcccccagtggaaagcaaaatagaaaggccctgtgtcagcagccaggcccctgggcagccgggctctcggctccattctgttcagtgggattctggttggcaccagctgcagtcaggaacaatgcctggatttctttctttctttctttcttttttccattttaatagaggggggagaaggaccagagccactcattgaacagctcagaattgtggaggcatctgggaccgtgtgtccttgaaaacagcacagtcgcaggggccccacagctggctgcaaggtgcaagaaggcatgatacactgggagctccaggtcccagccctgctgctgtctcatacttgcttgctgtgtgaccttaggcaggtccatgccccactctggcttccccacagccccaccagagcttgccttccaggacccactcaatgccaactcttcttcttccccgaactcttagaatggcattgggtggccgggtgcggtggctcatgcctataatcccagcactttggggggccaaggcgggtggataatgaggtcaggagatgcagaccatcctggttaacatggtgaaaccccatctctactaaaaacacaaaaaattagccgggtatggtggcatagtcccagctactcgggaggctgaggcaggagaatggtgtgaacctgggaggcggagcttgcagtgagccgagatctcaccactgcacactccagcctgggcgacagagcaaaactctgtctcaagaaaaaaaaaaaaaaaaaagaatggcatttggtgtgggcagtccttcctgagagactgtgagcccccagagggctggttctggtcatcctccatcctgtgggcctctatacctcccctgctccggatggcctgtcagcccccaaggccttgcactgggtgatgggatgtagcagtgagccatcctatgacctgcagccttgacagaagagggccatgtaacacaatacctccctagcctgtgaggtgtcatactaggaaatgaaactccctgtgcctcagtttcctcatctgtaaaatgagaatactaatagctcagaggatgggaggagttcatgtgtatgagctactcaatgcctggaacatagcaggaacttcacaagtaattcctatggttatgctgatgttggaggctgggagagcagcatatgggggttaagacaaggaagacggcacatctggtggaggtatcagggtaggcttccaagcaagtggttgcagatgtggccttggtgactgggaggggtgtgtcccaggaggtaggaagagcatgagcaatggcacagaggtaagagtatgtacataatgctggcaattctggaagtcaccctgcatggccacaggatgaggtgagggcaaggaagcatgagtcttgaggctggaggactgcacagccagaaggaggagagatgctgaggatctgagaccttcccccacccctctcggggtgcaggagctgtcaggaaggaagtgggaggcatggtcctcctcaggtcgcttgtcccagacttcctcatcagtgccgcatgtacttgctcctctggaggggcgctgacgcaggtgaggggacactgcatgaggagatgtggctcttgcaccccctcttgtccccccaccgagttgctgggactacaggcatgtgccaccatgcctggctgagacctggctcttgttccagctctggtgcttcccagtggtgcagtcagggaaagccatcacctccttttggggctcagcttagtcacccacaaaagggctgttgtgaggctcagagggtgagaggtgcctcatgaagggaggcgttagggtcattacctattcacagtcctagatagtcacagttctgagcagctccctccaggtattttcttgtccctactccactaaatggccccctctgaaagccctccctaaagcagggccgccctcaaactctaaagtgaactgtagctcagtccaagggttaaaggctcagacctacagaatcttaggacaatcagaggcaaaagtgctggtggatatcccacactctctcacttggcagatggggaacaggcacagggagagtttgtgatgtgctcaggccacacagcaagtcaggcaatggcgggctgggcacataggtgtcccggctcctgaggcaggctcccagcctattctcttgtgactcccatctgaagaaggggttggtggttgaactgggtctcgaaccatagggcagaactccatggtagaaagtgagaagacggctggcttgagggaaggacattggagagtcaagccttggaggatgggaaggtgtgggctcagagaatggaggggccatctgattggaaatgagggggaggcagagcaggggagcctaattcgctgaaggacatagatcttccctgcttgacccaaccactcacctcttagaggcacagggctcagagctgggcagggcccaaatgcttcctgtatccaccaaggggtgaactctaaatgtaatctccattacctcactgccatgggaggcaccctggtcattccctggcaagtgggtgagagtctttacttcaccccaaagtacctggtaggttaccttatctgcaccataacctggcagtgagatgagggcaagtccctattctcaacctcaaggcccagcccaacctggagcccaatctcggctccacccacttagcagctctgagatctttattgttttgtttcgtttttatgagacagggtcatgccctgttgcccagtctggagtgcagtggcacaatcatggctcactacagcctcagcctcccaggatcaagtgatcctccgacctcagcttcccaaatagctgggactacaggtatgtgccaccatgcctggttaatttttgtattttttgtagaggcaaggtcttgctatgttgcccaggctggtctcgaactcctgagctcaagtgatctaccctgccttggcctcctaaagtgcacagattacaggcatgagccaccatgctcagccagctatgagatcttgagcaggtcacttaacctctctgagcctcttcccttagcagggaatgacacctggcttgtggagagaatacaacgaatgtttccaaagtgcgtggcatacagtaagtactcaatgaatgagattttcttcccacctctctagtctcaattttagatgttccctggctcccttaagttccagaagtgagaggtggagagtggggacagagaaggcagctcctggacaggtgggaatccccactgtgtacccgcccccatcccagcccagcctaggaggccatactcgccgcaccctacacaagtcctttgcttccctcagggacctcaagcctcccacccccaccatcctgctggcctccagattttctgcctcctgaaacctgggcccaggccccagcaatggtcctctccccaatctgctggtggctcccacaggacagggaaattaacagcacttgagtgtgctctgaaggttggtacaacctggcggccccacactgcccatgccctcctagtggagccaggtgacttctgggcctgcaggggctgagcaggatgcatcttccagctctgggccacgaggaagtgatggcactgtcctctcttgtctcaccagcagatctccaggcccagtgaggctgaggctttgggggtgaggttgttggacacacagttcccagtgagtcctgatggcaccatggaccttacaggggctcagagggggaaagcagcttgcttggggctacacagtctatggatgaacagagccagggctgaggggacaacaggaaactctgttcatgggggcccgagttcccatcctgaccaatcttgggcaagtcattcacagttgagtttcctctgaaagggggatggtagcggcacctaacttaagacaatgtgacagttcaatcagggaactgaattctcaatacctaggaggacccaccacagtactcaccacatagtagacagtaaataagtcatagcttcttccaagaccccagaggtatccaatctaccccattacctccctggaagatgaacaaagagagcaagggcctcagagacccaaggactggagcctagggaagacccaggaccctggtgggctttctgacttgctgccatgcttgcacagaaggggagggttgaaatgatccctggttccatgctactaagttgagcctacttggctcctctgccctctgcagccacttcctgggtttcagatgtaaatactggtgggagagtagggggctgggatgtggggtagggggtggagcttctggacaggagactttgaacatgagtggtcacctccgaggtcacctgcatcccccaattcctggaagtgggcaggccctggatacttattgaggaatctggacagaaaggttgagagggctgggcgtccagacctagctggtcattaaggcaacaagaactggtctaattgtgggctgggctggattatcacatcccaaatccttaaatacccagaaactctcttttgggattttggacctgggtatggggtggctgctgccactgctgcaatgctgtggattgctgggagtgggacagctgtggctgcagccaccgttctgcaagcttaattcctaccttcggaggtttctcaggtggccctggtgtacctacctgtgaacttaggccacccacaggctgaggaggggctcaatcacacagcaatgtgctgggaccatgactccctggtgtccctagaggtctggaagtgctttcataccacccaccctctccagggatgctcagctgccacctacagggagggcgggggtggaagagcagcagtcatcacagtccatgtccatgtgacaggtaggaagactgaggccccaaaggagtgccttttcttgcacccaatggcatagggaggcagaatttcccctggggaaaataaaataacgcccccactccgccgcctgcgcccccacacaccccgtcccccacgcccgggtggacctaagcagcagttttctgagctttcaggaattccagactgagttcactggctgtgagactagcggagccttgagaatgaattcaaagctggcaaattcattttgcctcctctccctcggtggtggaaggagtgatctctccggctctgaaggagttcaagccgaggtcagcgaagccctcagaaggatgttctaaaatgggggtggggggtatgtgctccggcctgcttccccggttggcccaaggtccgcgctgatcaccgcccaagaggctggtacttttcactgtctgtggacattaaaaaagcgagcggcggcggcgggcgccggggagagcgggcggccgggcggcaggcgggcgagcagcgatcgggcggccgagcgagcgagcaacgccggcgcagcgcggtgaccccagccccagccggcgcggagcaggagccggagccgagcggatctcggcgccctcgctgcgctcctcccggcccgagcctgccctacccggcggtggcggcggcgcgtcctccatcggcggcagcggcgctcgcagcgcccggtaagtttggggccagagccaggcgcccgctggctccggggctacctcccgctccccggggactctcggggtgcaagcgtggggattgggtgctggggtttttcccttaaagtgtcccccggagcggggcgaccggccggcggcgcgggctccgctccgctctccttggcggccgggggccgaggcccggcggccggcgagctcccggctgcgcggagccggcttgggctgcgcgtgggggccgggtttgtcagggtgtgcggggcgtaagtgtggtcgtgcgcgcgcggacccggtgcccgcctcctgccggcgcgcctccagccctcgctccctacacccgggggccgggcaggaccgggaatcggaggagggagggaaggaccgcctcggtctccttcgcctcctctggggagatgcgaagttgtgcgcctgtgtgtgtacaggaaccgctggggaaagcgctggatttcaggatggcaaggggtggtggtgttaacttgtgcgtctgaatttccagggaaaacatacacttttgtaaatgggaggtgggggcgcggttaagttgtttgtgtgggaattgcccggggaaagctggcgcgcggtacaaacgagaaacgcggaggtgtgtgtgcagggttttctcccagggcttcgcaagccagaggggcgctcaggccagtgcctggacggggctgccccggccaggaggggagcccagggggaagatgtgcgtgtgtgtgcgcgcgcgcgttgcaaatacgaaagtaatttccccgtgttctttcttcctctccgtctccggcggcggtggccccgggggagtgggaggccagccggggcggaggttggggggccggggctggagccggggtcgggggggggaggcgggttctggaagcttgcttcacattcctggcgtctgggctggggaaaaaacagtggggagcgcggcctcggcgtctagggcgcgggcagcgggcgcgcgtcgccccctcgctggggacatctgtccaggaagccggccgggcggggatagggcgcggtgcggagggcaggctccccgccctggagcggtgggggcgcgggcgaggggcggccgccttcccggccattgtgcgccagcagattttcacgggagactgccccggagccgccggaaaggccgggagccggctcagccccgggtttaaaagacactccaggaatgtaaacaacccgggcgggagggcgggcggacgggagcgcgccagggcagccggcccgggccccccacccctccccggggacagccggtcggcactgccgcccagccctacccctctacctgcagcaaactttttccttctctgccttcccttcccacctcgtccctccagcaggtcacagagcgagggccgctcccaggtgggccaagggtgcttggtacccttgcctgaccggggaggcctgacggccgggtccctgcttcggtgcccggagccccggctgcgcctgcccgggagccgtcagcttcctgggtaggcagtgcccgagtaactggggctttgagcctgcccgcctgcctccctccctccctccctcccgctgctccttcccccgcgcgctctcccccttctcctctcccctgactgcttttccaatgccctgacatgagggaggaagatttaacttggcagcccaaacaaatgttctctcagaggtcctccaagaagctggcggctgggctggcggggtgagggcacggctcggccagcctttccctcctctctgctctgccacggacatttggagccctctgggtggacagcccagggcatgggagagtagggcccagccccaaagatttaaaagggcagtgggcggccgcctgtggaagcccctggctccgcgccgggtgcagagccgctccgagctgcctcctggtgccaagggttttctgaaggattttcttgagcaacagtttgtctccctgctgcaacctgggaaccgggcctggtagaccagagggttaaccagtgccgactcctcctccctggtgggtgtgaggacaggctggttacacagggcagggcaggaggccagaggctgttcccagaggtgcctgggtttgcttattactgtttttgaaggtacagataaagaggcaggcgccggggctggagagccgggcagcttggcgctggtgaattccagcctgcgttcgctggcgcttgtacggtcccgggagtgtgaagctgctgttgagctatcggggaagttgagatgagagagcaagctctttcttagccttctcagccccggctgctttgtgagggggtccagagtgggggaaattcctggcccctcacttgctggctcctggccccagtgcaggggccgggtgggtttgtgaataccccaagccttgggctgacctttccctcttcaagtcgaggatgttgaaacatcagcatcaaacaaaagacacattgaaagccctatctgctacagagcacgtgtgagttgggggcccagggaatgcatttggagggagatggtgttttcttctgagctttatgattttcggttgggttttgttttcccccaaaggacagaagcgtctccttgtcccaaatcacgaggttttgaaacgctgttttcacatgtaaatctcaaaagtttagacttctgagagttggtggcagtgactgggggtgggggctgggtggggggaggagaagggagcagtagggagtggattcaagaggtggatttggcattttgggtagggcttactgagaagagttgggaataagaaattgctggacttatgaataaatagccttgtctatgcagaaaagggttgctggcttctttgtggggacaaaatgtcccttttccctcctaagcaaaggggggaggagggttcttgttcctctcacagccaggggcaaaatgaagaaaggtccagagactgcggggtttggcgacagaaccagtttctccctcacgcacgcgcgcacgcacactcacttccctagccacaataacaacgatgtctccatccctggcccccatagatatgcctccaacataggacaggtgtccatgcttgactcattccagaaaattgcaggggcaaggacccaactgagaagagctgcagacttcactttttttcctgtttcttcctgatggcgggaggggtgaagggatttaggaaggaaggcactttgaggcctgctgcatcctgagagttttgtcacaagaatacctgcgtataaagccactgaccctgagggtccaacgagtggccatgaccctggcctcagggtgaggcattgttgtaagaaattcaggcaccaaccaattaatttccagaagcttctgtaggcacttggtcgtgggaccaggaagcagggcctgctggttcgtggctgggtcctctacattttcattcataactttgctccccagggccctggcccagcccctgtcactgctgcctggtctttatgaggctccttagattttgtgtggacaacaaaggccaggctgccacgattacccaggacactgctgcagccttgcctggcgacagctctgacctcttagcaggatatagtgctctctgctcatgccctttgggggagtgctctttgtccttaagagtccctcaggatggggaggcagcaatccacctggctgtaagctccggggcgttctgaggttgggccctgcctttagagaggatgaagggaggaggctgagaaaagcagtcctaggcataggctctggggagaggctagaccccatcatgattgagagggtctccctattaccggaggagatgggcgagaggaccaaggtgtcaggaggctgttgcttgctatctgtgttgggccagtaactctcctgtgctggaccttagtctcctgatctgtaaaatgggtctgagggcagaactcctccgatcccacttggttgctgggagaatgaggcagatgtgggcatgagtcccctaggcatgtgtcccttgaaggcctgggaggctctgggtacagaatgggtagaacacaaagggtttagattgcaagtgctagaagcattttgctgaagctgctctcatccagacctacttccctggcagctgattgtccagtcttggcttgcatgccccccacaggacagggtactcattacctcctggaagcctctgccttcagtgggcagttgtgagtgttaacatgttctgctacatgccttctgcaaatccacacctcctgaccccactctgggcttgagatgctggggggccctccagaccatagactcgttctttcctgaatgatcctgggttcaagaccagtgcctaggcaggcccctaggtagggggacacattcaagtggctgcttctagcccttattgggaatgacctgttgtggggggtgcagaagggggaagggtctgcctgggggtgctcactgtcatctgcctttgtgtgccaggtttgcctctgggcactttccttggagcggggtatgagaaggaagggggtgcgtgatgagggctggggttgggtcgggcccggcatgggtgccacaggtgttgactgtgagtgtccaccctgtggataaagactgtgtcctgggagagaccagaactgtggaagacagttcctgttcctcaggagcccacagtccagtgccggcaggaagatcagtccaaataaataattaaccgctaccagctggctgcctgccacgggcgcgtgatgacagtaataaccacagcccctctcctttgtatggtacttggtggatttagaagctttttccatctttgtttatccccaataacaacagtgtaagctagttactatttggaattatccccatttaacagagcagaaaaccaaggttcagagcggtcaaacaactggtggcaaagttaggactgaacctcaggccttaccgataccaacccctgcgctgcctcctttccagtccactgagtgagcgctccagccaggctcggacacggtgcagagtcaggataggctccaaaactgggtgctgggggaatgaggtgaaggaggagccattctcaggaagggtcacagatgggcctcacctgtcttccccctcccatatggcagcacatggtccatgcccccagtagctgtgtccctttcttttggcacagtgtcttacagccagagcttgcttcgagacacaaatcctgccttgactgcccagggcacacaggtctatacatggggcttcatgcccttctccggctctggagtaggaggcagaggtgtttccagccccccgggtccccatgaagcccagtgctcttccttgggttcctatggtttctgtagtccctcttcgggctgagtcagtccccaggctatgtggggcacccactccgtgtgagaccttaggttctttctgccccttgcagcctccacccttgggcctggttttctgtagctcagctgagtgccaccctaggacaaggctgtagctagtggggttcaggccggggagcagccgggcaggctgagctggcacctccccaggaagcctggcccagcctggcacacctgtgcaggtaatgactgtggcttgggagggccccaggccctgcctgtcaggcccagctgctggagttactgcaggattgtgctgggggaggctggggtgtctgagctaattagatttcttagatttcaatgctcccctaatcctgttagtctggctgtaattgtaaccacttgaaggtttcggctgtggcaggctgttgaggacagacggtggggggactgtgctctgccccagccccagctccacccctagacagccagctgagggcctggggactgccttcttaggtcttgaggatgggggcttgagtgatggtgggtgtcgtgtttttctgtagaaactgagtatcgcagactgtcagagtggacatagccctttgagatcacccagctcaaacccttcactgttcagatggggaaacttaggcccacagagggacagagactggctcaggaccttgatggctggtagcagtggagcatcaaagactagtggtctgactttgggatatttgtccctaggcacttcagggaaagtctggaatttccagggactagtgaaccctccagagacttctgcccctagagatagggcttggggggcttcatttgtccccaagcttgttccccagttggcagttacctgtcttatattcccccagccctgtgtgtgtgcacacctgcacacagctgcacacacatgcacacacatgcacacctgcacacatatgcacacatgcacacctgcacacatgcaaacgcatgcacacctgcacacacatgcacacactggccctgctggccagggcttctgccaggactccggctgcctggcccagggtcctgagacctgagagctctctccgtcctcccccaccactcttagccagatacttgccctcttggagcctctgattcaatgcagatcaggaaatggccaagctgttctgatgggggtgtgtgttaaaatacatacactgtactttccccagctctttcttcgaaagttctgttttggtgtctggcttaaatggagatctgtcctctctccccgcaccccattctcacttcccaatccgcaggggatgactggcagggaggatggggacggtgtgccttggatcttcccacttaggtcctgtgctgccctcctcttagctcgggagcttcggggaaagatctggaaagccccttccactgtgaacctctctgactctggggtttgaattcctaagcttgtagcataaaattagtgggaactgattgcgttacctggtctggcctttcctttcctagcccaggaaactgaaccatggaaagaaacacttggtctcatccaaggtcagcagcgaatgggtgaccgatctgggcctggaaccccatctccgccagtccattagctcatgaaacatgtattgagtgtgtgctgttggcctggcacagccccccttagccactcttgagctcattaataaatgctcttcgggtctgatgagaggcccagctgaaccttgggggtggggttcacttctgagtgctcagggtgaggacgaaggatggggagttttcagtggcattcccagactcccagatcctctgcagccaggggagtgtggaacactcctggtctggcattagagcccctgcccagcagcatgtgtctttacagggtggttgcattgtgaatttgagagaagtaaaacagggccgggcacagtggctcatgcctgtaatctcagcactttgggaggcctaggcaggtggatcatgaggtcaggagtttgacaccagcctggtcaaagtagtgaaaccgcatctctgctaaagatacaaaaattatctcggcatgatggtggtgcacgcttgtagtcccagctactcgagaggttgaggcatgagaaacacttgaacccatgaggtggaggttgcagtgagccaagattgcaccactgcactccagcctggatgacagagcaggactctgtctaaaaaaataaataaataaaacaaaacagaaaccatctagggagggtacaaggtttctcatctgccgggacctgtttaagccaagaggatggtagcttcccatacctcccctctcccctccagccagccctccaggagctgacctttgtcctttgcagagcaaatgacccactgacttggtcctgccttcacttcctctgtgtatggggaagcagggaggtggccttctcaccccaccctaggagtcacctgctgagagtcacctttgtcagcctaggtgagagcacactaggaagagccagctaggctcaggacaaaggaggagatgccaggtgcctggaccttgccctgtccacaggggtcccacccaaactcctacccctactccccggtggaccttgaccgccgctgggaagcacagtgcacagctctaaccactcagcgacctagccaaggatcagcagggcacagagacctctgggaagagtcctgaaaccctttcctggtgtgtgcaagtgggacgcgaccttatagggtctctgtccaaccttcttattttccacatggggaaacccaaagcccagagaggtggtgggattggctgggggtcatacagtggggtgtctcactaagagtggggggttctgtggtctgggtggggaggggtggggttttccatcgaaaaatggtgttccatcgaaaaatgctttggtgttcctgctgttgtttacatacttaaaacaacttgccaaaggtctgccataaatataatagccagcatttattgggcaactaatgtgtttcatgcttttcccagactgcctgggttcagccctcagctctgctctttatgagctctgtaactttgggcaagtaatgtttaacttctccgactttggtctccacatctgtaaaacaggcttactagtggtgtagtaataactaacatactacctcctccataggttgagaagatggagtgcgcaaacttcctggcacatagtaagtgctcaagaaaaggtagccctagtcatggtcaccaccagcattcccattgccttacctctgatttacagatgagacggtgaagtcgattgcccaggtcatgtggtgcctggagcccaaccaaagcggcctgctggcacctaggcttcctgatctccaactccctgccgttttccacactcttgtgtagcacaaagggctggcccatcatctctgagaggcccccagtcagtcataacccaagtacattgtaattcaacctactagggcagcttgttccccttggaaaggcgttcgagagggaggtgttgcatctgggcttctgtctgagaagcttatttttttcatgtgtaaactgaggctcataataacaatacctactttttggactcttctcgtgtgaagggaaggaggccacagagggactgggcttgtcagttgtaccctattatgtggaatcactatgaatggtaactgactggaacttctggccagtcactcacccctccgagcctcagtttcctcatctgaagaccatgagccgaaacaacataatctcttcccgaagtggcttctcagggccaccagtccccaaaagcaaaagagagggcagcagagcacccccacccccaagaaattgtcaaacctatttgcctggaggagatggctcagagtaaatagtttgcttcactcagcctttccccagactacagacaccacccacccccgacttttttttttttttttttttttttggagtgcagtggtgcaatctcagctcactgcaacctctgcctcctgggctcaggtgattttcccaccacatcctcctgagtagctgggactacaggcatgcgcacccatgcccagctaatttttgtattttttttttttttttttttgcatatggtgtttcaccatattgcccaggctgatcttgaactgctgggctcaagcaatccacctgcatctgcctcccatagtgctgggattacaagcatgagcaccatgcctagccccaccctttttttaatgcaaaataactatggaaaagaccaatagaccattttgggaaacgcccgcgtaaacagtccctttcagctcaggcattgcagctccatccagcggatggtttacctactgaagaaccacctttccaggggagcctttcacagaggagaggaggggacagtgtctgcagaggcagaagtcttcccctcagcctgctttcttggcctttccacctctttttaacccaccctccagcctcccacttttgccggcctccttgtcttttctttttttgttaccagaccacaaatctgtttgtggttgggcagtcccaagagcaaggccaactgggcagaggggtggggcctctgccatgtccctagagacaggccccagagttttgctggctgtcagagccagaaggggtttgtttcacccgtgggggctgtgggcccccagaacctgtggtcaagcctttgcaaacgtgcactttcctggagaggtggtctgaagccttgtttcagatccttaattcaatgtggacacctggaaacagtgtcgaaactatagccttagtccaagggtctgtagtccctggccgttgaatggagtggaactgtcatgctgcctttctccccctcttccattccacctcagtcgtgtgactcttgaagatgtgaatagatttatgttcacacctcctgcttctaatccagcttgacatgttcctggcaaggaaactgtgaccaagggatgtgaagcgacttgaccaaggccacagggcctggcactggggccgggggggtccagggaatgatgagtgagtggcaggcaggcatggccttctgcagcagctgacttcactgtgaagccatcccatcttgtcctctgtgagacctactaggggtgttgggattcagtgtcccagaaagagctggcactggggtgaaggaagtccccgcccagtccctcttctaggaaggctgggcaggactggtttaggagttgcctcctctgggtcaggaggtcagcttctgctctgcaggctgcattttgtgggtcccgcccaggttcatggttcctcttcgggggctgtggggaccactggcacttatattgaggggcacacggtgtcttcagattgcccggctggtgtaagctggttaggagtccttagctggggttgttgtgctgttggtggggagaggcagcctggggcctccagagagccgctggccggccactctgtaattgtgcatgagtcactctgcctccctgctcgcagtcctcatgtccccaccttcctgggatcctgagaagtgggctttgtgatggttgggagcaagtaaggggatttcttggctctccgcctgtctgccctgtgtgcccggcatacctgagctccacaacctccctgcgcctcagatcctgggagaagagcagaaagctcgggtgtgactttttttttttttttttttttttgagactgagtcttgctttgtcacccaggctggagttcagtggcacgatctcggctcactgcagcctctgcctcccgggttcaagagattctcttgcctcagcctcctgagtagctgggaatataggtgcccacaccaccatgcccagctgatttttgtatttttagtagagacggggttttgccatattggccaggctggtctcgaactcctgacctcaggtgatccgcccgccttggcctcccgaagtgctgggattatagacgtgagtcactgcgccgggcctcaggtgtgatttcttgtttggtgtttggcgatggggctgtgaagctgtgagtttgacgtcagtttatctcctgcaaaagaatggccttctgattcctcccacctggcctgggttgacatctgcatttctgcttgtgcttcatctgcaggactgacccctttaggcagaaggagtgggtctgcattgggggttggaatcctcatgggcctcagaagtcttggcgccttctgccttgtggatggcctccctcctagccagctccccagaggggtctgggcagctctgctccacccgaaggctctggatgctcctatttctggtattcttggcacctttgattcccaagaccattagggaccttggcgcccatctcatctgatgcctgtcatacggatgacttatgccccatctacgctatccccatagagcaccttcccatgtgggcttgcatgcctccacggacaggctgctccctgcctccccagcagctccctctgtctagaaagttccacatcgtatggagcccagaaggatacctctcccctagttctcttctcaggaccttgcagaatgtggtgaatttggtcctcaggaagtctcttccattctctgcctcagagattgtatcctcggagacttctctctgggctgagtctaaggctggagaaggcagaatgggcttcctggggaggtggccttcttatatcccctgggccttattatctctgcctctggtaagagtctgggcagcttggagacctgagacctgacctgaaaatagcctagcccaggttgtaagacgtggcagtaggctggggaggccacaacagtggctcactggggccctaggggaagaaagtggtctggcttctgcttttcaagcagggtcagacattccaggaggctgagaaggccgtctgtcttcctagcctcttgcagcatgctcgcctgccactgcagccagagccccctcactggaggtagccaggggctgtgaatagtgcttcctcccctgtggaccagcacccagctccttactgagctcctctctgcctggccctgccccctgccacttaggcgcatcttgcctaagtgtctacaggcccctgagacctgggctctgtgcaaggagcgctggatttagagacagaacttctggcctcctcctgccagcatcgctgggggctgtcgcacgagtccaaggggaaggccagcacgttgcatgctgtccagtatcactgcatcggggagtgtaatgtttcattaccatgtgcaatgatggtaatggcagcacagaaaggccctggagaccatccaggccaaccttctcatttagatgctgagtcaaaccccagaggggacgaggtcacacgacaagtccctggcagagctggagctaaaatccaggtgttcccaccatctagccagtgcccagccctgcctgttactccacagaaaccctttgctggagtaaggcacaggagaggtgcctccatggctgtggcagtggcactggcctggcctgggactcaccttcctcattttgcaaagcggctgggcctttcggctctggctgtgcccaccagaaacactcgtcctgggggcaggcactcggtgcctatggtcttggtaagacagctggctcctccagcctgggggccgctgccctatagcaggacactttctctcacttcctggcttatatggggctgccttgcattccgccttgggtggcaacagggtcctcaggagcccacctgagaccccacgcccagctttttggctcatcaggctcatttggtggcctagaccatggcttgaatttatggtctgagatgcagcctggtgtgatcccttccaggcccctaagacccaaagatgcccaaactattggagcaggagggacctgggcagccagtctacttaatgcccttctcatcccatttcccagattagagccctgaggccagagagggaaggaatccagctgcagagctgcaggcaggatcccatgtcctcccagcctcactggcttggtctccccctacttccaccctttgcgcccgaggctgtccttggccttcccaggctttgtgtggagtgaaggacgatgggggacaatgggcagagtagcaactgctacttttccctcagggctcctctagacctctgccaggccctgcgtcgcttccagttctggggagcccatgcactgaatgggctgggagggtcctgctggtggggcctcgtgccagcctgagaacaaggcttcctggctgggcttgagtccccagcactctggccctggggagggcagagtctggggtccttttgtgcctcccctcgcccagctacccaaggaaggtggattcatgtattcctttgtcaagtttatcaagcaccttccatgtgccaggcactcttccaggccctggggatacattggtgaatttgacaggggacctgcttacattctagtaggcgagacagtcagcaggtcaacaacttaatgcatgacatcatgcctgagttataatcagtgctttgaagaaaaataaaccaggataaggtgatatagggacatgagtgggtgatggggcttctttagatggtgtggtcagggaaggcttctctgaagaggctgcatttgagcacatacctcagggagacagggaagtgaactccatgaacatttgggagaagagctctccaggcagtgggaacagcatgtgcaaaggccctgtggcagatgcttgtttggcgtggtctgggaaaagcagggaggccagtgtggctagatggagtgagggaaggagagagtggggaggaagtcaacagagtgatcagggaccaggtgataagggacagagagccttatcaagtacaggaagggcttctgacttcatgctcagtgatttggaagccactgaaggattttaagtaaaggactgaggctatcagatgtgtcctctaagatctctggctgatgagccgagaatagactgaagggacaagggtggccacaaggagaccatctgggcagcatttacaggaacccaggaaaggatgctggcggcttggaccagagtgttcagtggaggtagtgaaacaaggtcggatcctgaatgtattttaaagattgactgaggctgtggccaggagcccactgggaatgcctgtccacctccgtgaaacaggctgagctagagaactggctcaagttgctgtgtcctgggagtctgagcccttctccttttgtgcttgtcaattcctgtgcctcagccactctgtcataaggtggccttttaacagttggaaaaatagaggcatagtgggtcttcctgatacccttgtctacccttggaattctgatattctgcatttggtctctctcctcccctctggctgattccctggcattcatcccctgcatgttcatacactccactctatgcaccatagtttcccaacatgttagtcatcctctatcccgaggcctttgcatatgctaagtcctccacctccactcttcagtcaggtgaactcctacccatccttaagagcccagctcaaaagctgccatctttgaactctctcccctgacactctcaggcactgaggatttcttctccactgaaaattctactcctctccctcccacactctattgcaagggatcaactgcgtggggctgggtctgtgccttccttcacacctcctctttctgttctgtgtcctcacagcctggcccagggccagcacagaggagggaacaaaaacatttcagtgtattcctggagcagtagttggttactatggaaacaaggaagtgttgcaacttcctgaacttgaggttggggtcaaagagggcagctctatcttggccacacgggatcaacccaagatggccatgctgaggttcttattaattcaaagtcacttcggacaggctctttcccatccctgagcctcagcttaccccatcaataagatgcaggtgttgggactgcttgactgtctgctctaacgttctgtatccttgtgcctccaatcctgccgtatgaacacaggcaggtcctttgccctctttgagcctcagtttccctattttgttgacctctctccaagaacatagctgcctgagtcaagcaactccagaatcctagggtcagcggctgggctggccgttgatgattgaactgggattcttgtgacttgcagaggcacaaagagggaagtcctgctttccagggtggtggggtgggggtgggggaatgaggcagcaggagggtgggttggtagggataatccaggccggctcactctggcctgaacctgcacaggcccctgggtctcctttcttcaccttgaaggtggcaggagctagtgcttgccaggggcccttggctctgccggacgctgcccgctccgcattctggtgccgtgccatgtagatcccggcctgtgctctgagggccacaggtcctgtggtggccccagaggctgcctgctgcctgtggtggcagggctgagtgggtgggcaccatgttcttactgtgtctcttctctctccacttcattgctcagaagccaagagttagccaagcacaaaaccacagcctggctgctggcaccctcctctgcaaccctgcagcacctgggcaggctggttctgggggctcagcaccagtcaccagggctcggatgtagcctcctcaagctgggggtgggggtcaaggggccaacatgcccagcgtgacgccaggcccgcagttgagttcccacctgccatttgcacatgccattgggcagagtgggcagaggcctcagcccgcataacgccccaccctgactcctgcctggcactcaggtgccgtctggcctgcaccagacccagaaagagtgacctgggatgagaggccttccatggctctctgggcctgcctcctcatctgaaaaatgggcagagggtgcccgcctcccatggccaccaggaggggagacagaggaaggcagcttgtgatctccagagcccaataaacacacttgttaggattaccagcagcaggcaacaggcttcagcccaagagatgcccctgagaacctctttttcaggaagcaaaagcccaaaccttttcagaatgagactcttattctgggaatgagaagtgcctctccctctgtttctgagctgtgcccagtggccagggacctgagtggccatcacaacgtgcctttcccgcctaccactgctccctggctttctagggttggagttggatgaaacccctggggcagcaccgggcactggaagggccctggtaagggagaggatacccactgcccatctctgccactcatcagcttcctgaccctgacgagtccttgtctctctgccctctgtgcattgaggccccttctagctgggactctcctttggagtctactggagcatttttacctccaggataggtgaggctccctactccagacccccaggatgtaatgtgggtctcacctcaactcacaaaattctcacttctgttaagaaagggccttgccatggttgacggggatttgcacttcaccgtgtggacagtgacagaatgcgtctccccgcccctccttacctggcaaactttgtcattacctcctcccagggacctcctaggcattctcctctggactccctcagccctcagccttctcctcctcccggtaccagctaggtcagacaagacctggagcagagaaggtgcccagtaaagcctgatgagttcttgaatgatcaagtgaaagccctcaggtatccagatagttcagttggccagaaagcccatttttctcagattttactcagctatgtttgcttgttcagcatatagaatcctttttatttttattacttcattttattttgtagaaactgggtctcagtctgtcacccaggctggagtacagtggtgtgatcatggcttactgcagtctcgaactcctggactcaagcgatcctcccacctctgcctcctgctgggactaccggcacgagccatcaccccggctaattgaaaaaaattttttttgtaaagacgaggtcttgctttgttacctaggctggtaggatcttttgttatttattttttattttttaatttttattttttttaaagataatctttttggaagctctgtgtccaggactgattctctatacctttggccaatctctttcttttaaaaccagggtttcctgaattgcatttttgcatttcttttatttacctggtctgtgcaactatttttttctcttttggactccatatagcaaataattctgcctctccttttatttgaatttctcatgccaaaaaggcagggagggttagtaaacactgctttggttgttctttgttttgttaagtgtttttaacttcttagtgtgttagattagattttatctgcctttcctacctgccttaaccccaggcctctaaccctccaccttcccattgcttgttcactggcattgtgtctcctaggacagctgtgtgtggtagcgcatgttgcgcactgcacaagttgggggtggtactcacattttagtcccctcacattatacatgtattagatgattttttggcaggtgatggtaaagtgttggaggaaggggagcctggttctaattctcataaagccaccttggattaggagtaggctgacattgtcccatggtcctggctgaaattgggaagtcattttgactcctccccagggctgtaccccgtgacattgggtgtccatgtccccattcccctgcccagagcatggcttatgggagtatgtagtcagggaactgatgtctttggactccaccttctggatgtttctccagccacctctcctgtctacatccccaggcagcaaccttctccctcaggtgtctacctccagcttccccttttccatcgccccttcacttggctaccagtgtgaacctgaataaaaggcacccctgatctatcacctcttccactctacttaaaactccttcgtgcctctctacgatctacaatctgaaattcagtgcccttcattctctggccccagatgaactttcacttgtgtgtgctttgcacgttgtgttcctctctgctctgtctgcctggagaactcctaggcatcctgcaaactctgcccaagcctcagcttgccctcatgcaccagctaggtcaagcggattggtcctccccttgccccggttccccaggcactgtttcctgaccagtgttgcagcccttgcttggcaggatcgcagctacctttagaataccacagccaccaccaggctctggctccctgtcacccagcagcaccagcttggatctagcaaacattccagtgcgctccctgcaagttgaataacacatggtggctaccctttcccagagctggtcggctttgtgatgtggaccatgtgcatggtctgacccctggccccttcttttgccctttcccctgccagccaaagccagagagatggctgggccatgccaggctcccaggagcgctttgtgggtcaggttgttttgcccaaagctactgggtctgaggatacctgtgagcttgctgtgcctgcattgccgctgcccaggcttggcttcctgggagaattggctcggcaacagcagcctgggccaggccacaaggcttcttgggcaaaactccgtgggcagggccaggggctggggcctcatatgcactgcctgtgcaccaggcgagtctgtgggcaaatgagctccagcttgccatggtgctgggggagggccacccttctgctaggtaaacatgggtgttcaggcctgcctaggcacggccctgggttctttcggttaaaggtgcaggacagcattttgtcgagccgggagttgccagtgagagggtgacagagagggacacatgggaaccttcaccaaccttccctgggactcggcccctacaggctttaagcagaggctgcaaggaggcttaggggtccctgggccaggactactgttccgactctgagatcttttatctgctgcaatgctggctgctttctgggacttggggaaggtgggtgggctgtgagcaggtgcgtttcctaagccaggtctgagaccagagcttccatttagcggtccccactgcaaatgcatttcagtccttgctcccccaggcaaagctcacatccttgggaacatccttcctgcaccaggcatggtactttggggtctggagactgtcgcagcacccctctgaagtgggtggtattatcccattttgcagaggaggaagctggagttcagagtgctgaacttgttcagcctccacagctgctcagggaatcaggtcttctactccctacgtgaggccacagcttgatttttcttttctggtccgtggctgtttgtacaaacgagtatcctgtggacatggttgtctgcccctgcccctccgacaggacagcgctgagcaggtacctgggctggtgccacacttggggaggtggacacgtagcctcagagcccgaagcaactggtggggttcattcccatggaggagaggttctccgtggtccacggccggagcctccgcatgtcagatccttctccccacccagatggagccaagtgggccccacatcagtgaaggaaaaagcccttggctcttgtgcaaacacaaattgtggaagagtggcatcaacaacacgaggtgctccccatccatccggctcactttccttctatgagatgaactcagctcagggtgttttgtgccttctccggtttgctctagtttggttttggtctggtacaattgaagtctttgcctccttccgacagaagcactggacccctctccctgggccctgaaaacccggaggggtactgggactgctgtgttggatcagaggagtcaggtagaaattgggggttctgggtgcagggagcacttgaggtgcctgctgcatgctccctgaagacaaaatcccagggaggatgtgtcagttccgagggccactgagatcaccacctccgtgagcatgagcaagaccctattggccgcacctgggacagccttcctgggcagggccagtcctaccacctcctttgtccctctcccactccccagacccccaccccctacccctcaggccacctgctccctttttacccaggcacatgtccatgtgtgcccttacaagctcctggctttcggaagggaggggacaggttgtagagagacgggatgcgccggagtgtaattttatttctgtggctctcctttcaagctgtcacggtaaatctattttacttgtcactttgtaaatcattatgcaggattaagccttttaccagcttttaaggcttctgcaaccagggacaaccccacctctccctcatcctgccttctttccctcacctcccttctgaatgaccctactgctgtgtcttaaggctcagttagaatgtaagtggggacccaggagacagcttgctgtcattgagtttagctgccccattttacaggtgggaaaacaatccctggagagggagggactcccaggtgcagtgcctggggtgcttagtgttttgtggtgcccctgagcagtggggagggaagttgctgaaagcaaccgagcctgggcatgggacttggagggttttttttctcatcccccatggggacctggaggccccctgtggctgtggcaagattgctcaagacccacaaggagaccccgtttggaagaggagacatacttggagggagagaaggaccttctgccccctctcagggtgtggggctggtggggtaggggactggtgacaggaagctggaggtgggaatgtggtcacagtcaccctactggcatgtgggatcccgtttatttatttctccagaaatctgtgtccttctccagagaaggctttgaggtgcaagaacaatgaagccatgtgctgagatgttgagagttgcagatagtggctgggactactaggccaagagccagcagtgtgcagcggtgcgtttcctttcacgggtccatctggagcagcctgctcacaaaaccagagtgaaaagatgctcacccacaaggctgatgtgcattgtgggagctgaggtttggggggtgcccactttgagaagccagggatgtatgtgcccagggccagactgcccagctgggccatgccgggtttgacagccttaggtcttgctgccttttccatcgggatacactggcctcatcgccaggtcaagggcttcctccctattgctggggttccagggctgtcctctgcccgtctgtgccaatagagggccccgccttggggggcccacactcacctgtcctgcttccaccactccccacctagacctctgctgtcttgagcccagatgaattaatctcttgcagcaatttcagtctaccaagagaccttctccagcatcttctaggggagggtcctgtgctttggggaagctggactgggtgacattcatttccacagccctctttgctttccctgttcaagccaccatgatgtgcaatggcagctgccttttttttttaacttaaaattttaaaattttgtgagtacataagtaggtatatgtatttatgtgggcaactgcctatttattggcctatttctagactcgagctgttctgcaaagccagagccttgtctcttatcccctagcacgggggccataacggcacaggctaaggcaatatttctccattagaaggatggccaaacaagagtcctcagaccctgacctcaaggagtttcacagtctgcattggaaacaaccttggctactcagcagaatagctgcaatgagtactgaaagcttcagagaaatcggctaataagttccaaggagtgagatgagaatgagctagagtggtcggtggggaggggcctcctggaggagggggcatttaagggctgcactgaggatggagaggctttagctagaacaaggcaaggagcgggaggaaaggtacttctgggcggtggaaccggcatgaccaaaggaagggaggtgtgcctgtgggggtgctggggcagctcagccagcacccatggactttaggggaagaacagaggccaagtttctagggatggctgggaccccagaaggaagccagggttaggagggaacacttattctagaagtggggagggagaggtgtgtgacagactgggtgaggacagagcagtgttttaggagatttagtgacagggagccacctgggttggaggagacctgagcctattaattaggcaggtgagtggagtccctgaggtgtacttcaggaccaaccaggctccctgtactgggtgggatggggcagggcttaggggctggtgctgttcccaccagccccgctccatgctgagtgggagaggaggtggcagcagcagctggggcttctgaagatctgggtgcaggcttggtctggctactcctgtgcctctgtcctcaacctgcaaaatggggagattctgcaactccacccagcctgtctgcctgctgctgtgaggagtgctggagacacagggaggggaagttctttgtgaactgacattgcctgttctcatccccttctggaaaactggtggctgccatggcatggccatttcatggctgctggcttccctctgttctccagattgggggtgaccctaggacctgggtttcattaccaacaagccatgtgatcttgggtcagtcacctccctcttccaggccttggcgttctcctccataaatggatccgtgctgataacctaagcctcgctgcacgcagtgtggctgttgttgtgctaggagacccaggcttgggctgcggctaggggtgtccccctgtgggcagagccccatacctgttgtcacagtagcatcgcaacacctccttataagccttggaacctcggccaagaggtttctgtgtacgcttcttggtctctggtgacttctaggcccatttgacatttctttgcacttcctgcccactcctggaggcccctgattagtctacttggttacaaacccatatcagatccctgatatctcccagcaagccttgcacaaggcatgtgcctttaagtgatgctcgtggctctttgaaatctggacaccagctggcagaggggtggtcaggtagctcgcttttctgtaagatgggtgtattttgttttttttcttttggaacagattttgattttctgataatagagcccttgagatagtgaggagacagtaccggaagcagcacccccaaagccgtttgaatacaatgcaagcagttgaggggctgagctaccagccagtaggagagagggtcctgggggttcaaagagcagtgggggaaactgaggtacagagagtacccagcaagagaatgaatgagtggcaggtccaagcttcagataattattattctttctaccaccccccccacccccaacacacacacacacacacacacacacacacacacacatattcaggggatgctttaggttctctgcactgtgccatgcagtttatgtgcattatctcatttactgttctgaagaaccctacgcgggaaggactgctgtaccccagttttattttatttatttatttatttatttatttatttatttatttatttatttatttattttgagacagagtctcactctgttgcccaggctggagtgcagtagcgtgatctcagctcactgcaatcctgcctcctgggttcaagcgattctccggcctcagcctcccgagtaactgggattacaggcgcctgccaccatgcctggctaatttttgtatttttagtagagatggggtttcaccatgttggccaggctggtcttgaactcctgacctcaagtgatccacccactttggcctcccaaagtgctaggatgagaggtgtgagccaccacgcctggcctgtatcccagttttacacacatgcgtacgtgatgtgctcagagtgattagggccacagagccagaaggcgttttaggcaggatttgaatgcaggcctgtgagtttagatcctggctcccactaccctatgcacaccctcccatgcccttgcgtgcctcttcagggcctctctctgggccatccctgccgcaagcactctgcagacagacagtcttcctctttctaggaggtgtgggtgcagaggactttgtgtattggggagataaaagagcccgtttgggatgatttttatcagctcgagcaagtcggtttgacttacaggaagaagccaatttgcattttgggaaagagctgagtgtaaaggccgcagtgagcactgggtggatttataaataaacagtcgaccgagggcattgtatgtccccagctgtacaatgctgggttcatattgacaccacagacctgttccacacgtcacagctgccctttggacagaaagggcctaattgagtaagagagcgctgctgctggaaatgccaaggaacccttcctccgacctggcttcctcggcacaagcgagccgggtgagtccggctgcagccgggcctgtttaccgaggctgctggcattgcatgccaggtgcagagcccacgggcgactcagaaggccacgaacgctggggccaaggcggcctctgctctccctgcaacccggagggagctggagccagagccagatctcaggaaactggggtcattgcatagaggctgccagacagtctgcagagctcagcggcctgggttcaaaccttctcgcacactgccactgtcggttactttggctttctagagccagattccttggccatgaaatgggtactgcttacttcccaggttattttgagaatgaagtgagatgaagtcaacagtagatgtatctgtccgttgtccctgccctgctgtgggatgacagagtgattttggacaagaccaaggcctcgctgggcatcactgtcttcttcagaaagcaatggggctaggccaggtgcacagtggctcacgcctctaatccctgcactttgggaggccaaggtgagcggatcgcttgagctcaggagttcgagactagcctgggcaacacagtgaaaccctgtctttaccagaaatacaaaaactagctgagcatggtggtgtgcacctttagtcccagctactggggaggctgagatgagaagattgcttgagcccaggaggtcgaggctgtagtgagccacagttgcgccactgcagtccagcctgtgtgacagagcaagaccctgcccctcctggaaaaaaaaaaaaaaagagagagagagaaagcaagcaagcagtggcgctggatgctgatcagaggcctggggcccttggaccagagagggctgtccctgcccagctggctacaggagctctgactctcagaccagcctaggttcatatcctgtgtcttccacttgtgggaccttgggcatttgacttcctctcaggacctcagttttcatgggtagaaagtgggaacgattaaggttgttggaaagacaaaatatgctcatgtacacttagtgctcagcatagggctggccacatggtgaatgctcataaatcagtcatgtctataacatacatttcaagggaaaaacatctgttttgagggcagaacgctatcaagtcaaatattttcctgatttaatttcaatagtactgttataaaaaacaataaccatgataccgatagttagaagaccgccccttccaggcccacttctttacccctttgctttttggcaataacccttgtgcagagccaaccccattctcctgacctaaccagttctcacctggccatgcggcctttccgggtgtcaggcaggtctctccggttaggtaagggaggcctcatccttcttacctgactgctctgagtgcagatctatgctgcttcccatcttctccaggcgcctgatctattaccttgggcttggaacgcacctaacaaaggctaccatgaggaggcccctcggtacctgttcatctggacacatcgtgcagacccccgcaccccgtgtggctcccggttaatcttcagggtgcaatcaatttcttcctcagaggccagacttcattgttctaagcctttctcagatccacatcttggggctgctggggtccctgcatctgtgtcctggtggtcagtttgaagcaccagcagacagcagcgctaaaggcaccttgtgtgtactacgtgtggccatctagggatgtctcctctgttgctgaacctgcagatccccgtgaggcaggtggggccacaggcctctcccctctgttttataggggaggtaattgagcagaacttaggacagttacatgctttgcttcagttgcggggctgggatttggacctggctcctggcctgacacaggtcctcagcttccaccagccttgctgcctctgaaggttgctggagaaaggaagctgaatgtagagggtgggtctggaggagagggggaggagatgagcccagaaggacaaatgtttgcacaaggagttagaaatgagatgtctaggctgggcacggtggctcacgcctgtaataccagcactttgggaggccgagacaggcggatcacaaggtcaggagatcgagaccatcctggctaacacggtgaaaccctgtctctactaaaaaatacaaaaaaattagccaggtgtggtggtgggcacctgtggtcccagctactagggaggctgaggcaggagaatggcgtgaacccgggaggcggagcttgcagtgagccgagattgcgccactgcactccagcctgggcgacagagtgagactccgtctcaaaagaaaagaaaagaaaagaaaagaaatgagacggcttcaaagaacctccagcacgtggaggtgaggggtgggaagggctctgaaaccattggccgttttcttgagtgcttcttgacccgaaacgctgccttgaggggttgatagagactggctccttcagtcaatgcctgctttcagacctggatgtgggggcctgctgggtgccagccccctgctaggctctgggaataggacaatggccagaacagataagatccctgtctgctgggagccaaagagagaaaccaggtaaacaagacaatcacaatcaaggacacctttataaattatgataagcaccaagaaagaaacaaacagggtgctgaatagaaaaccacccagaggtgagtgtgggggccttgagacaggaaggcctttctgaggagggccgtgagatgatggggtgggaaaagagagcacacaggcagaggaaacagcgtgtgcaaaggctagagacagagaggggtcccatgtggctcggggatgaccggcaggggcagagcagctgaaacacggtgggcaccatgcatatcttccagctccacttgcccccgggtcgccagcagtgctgccagcctgctgtgggcatgggctcaggtgtggacatgcctgtatctgctggggggtcccacatggtgctggctccctgcctcagccaagaggcacatgacacatgacatcactggctatttctgcctcccaccggccacctccatctttgcagcatgaagggaggcctggcctgagcccttaactggtcccctggcttggctgtctgccactgaatatcacctgctatttcagtgaccatcctgctgtcatagagggcagaggaggctgaggggtgcaagggctgtcaccaggggtccccggacaagcccaggttcttccgcctagggtcagccctggccctgcaacctttgtttatttactttgggccttgctcaaaactagtagcaagctgcctggaatgcaatgtgacgaactcgagataataataaaatcaattggactgtttccccagtaattctagagactgatgcatcattaatgttggtaatacagtgcctgtcagatcacaaacttctcaataaatgtgcagctggcaagctctgatagaaattggaggcaagcagagaatgagatttggggcctttgatatatggggtgtcagtggcgcagtgaagtttttatcaatttctgtcactttgggcttttgtgctcacagcatatgtggtcttcatggcacctctctgtgggctgcttggatgctaactgcacccccccacccaacagtgtgaggaagaggagttcctggagaggcctcagcagcactggtgcccttctgtgcagcttcattaccaggggcttctcaggcagacgtagacgggcaaagcctttggacttgactctgtggatcactcaggcactctccaagcattgattgagtccctgttggattcaagatgccactgggccctcggaggcctttggaggctctggaggacttgatggaagcctggggcttggggttgtggggaatggtcaaatgatcattcctacctaagggtcaggagaaaatggaagcagtgtgtgagctagcctggaagtgtcttgccaggtagactaggagaagagactattagactggggagctctgtgggcccaggccctgaagcatgatgaatcctggagtttatgcgggagtgaggactttggccaggccaggccccagcggcattggagagaaggcagaagctgcctggaggcagtgtagtgtggtggttagcacaagcactctggagctagacaggcaggctccgaatcctagctcccacacttagcagctgggcaacctcagggaagtgactcgaccgctctgtgcctcagtttcctcacctgtaaaatggaggtggtgatagttgaccacctatctcgaaggactctagcgagcataaatgaattaatacttgtatgagtgcctggtccattgcaagcacctgataagtaattggcattacttttgcataatgagctcagtgaacccaccagtcacctgaaagccatacagtgagattcagagagttgaagtggggcatccgcactcatacagccgcccagaagcagaactgagatttgagtgcaggtgatctcaaaacctgcgtctctaagctgctgctgaggctgcggttgagaagcgtgggccttgggtgcccaggtggaggaggtggcatgcggctgggggcccagcaccctaccgaggacaggcctgtgaggtcaccgtcattagcaaggagattgggtgggcagtgagtcagctcaggcttcatttgtcagtagccctctggagctggagaacttctgagactggggacttgactgtggtgcagacgtctgcattggcccctggaggctggaagtggctttgagtagcagaggagccaaatgggaaccatgttggcggcagattccagaagtgagtcagaatttcaatgttcccagctcatctgcttgagagcaggtcctgagacccagcaaggcctgcaccccctcctcgacacccacccaccctagagcaccacagtgtctgcaaaccagagcggagggtccctaggctgtgggggtgacttgggtgtgcgcacattctgatgcagctatcactgtggtgcacctgctggggacccaccgtgaggccccgggagtcggtgtgctggtgctggataccagcgctccttgagagtgccctgggcacagggaccccatgctcccatgagcaggggtgctcctggcccttccccaggctgcctttgaaaaggtccttccccctccccatggctccacacaacaccaggatgtactcctggctggttctgcatctgtgtttgcctttaaaaaaggtgggttgcaaggccccccagggcctcaggaaagaagaagcaatcttgttagactggggtgtggaagacagaggggcctgtgctgcactgggaacagggagcggtggcctctgggcccaggtctgcccccatcccctccccggctcccttcaaacctccctgagcctccatgccctgcttgggacgtcccagtgtggagcccaagtccctgcacttgttgggtggtggaggatagctggtcctgcatttcccaggtgatgtgcctgggaagcatctctccataaaccccctgtgacttgggcttggaggaagtgtcccttcctgccagaggagcgggggctgggtgaagcattgagaggagctacaggtgcatttgaaaaagcaggtaggtcttctttttaccacctggaggtcctggttatgggggcaggtaggagcacggtgctgacatggtcctaaccggtgtggttcccatcactactgcttgtatgacccgaacaagtctccagccactctgaatgtcacttatcaccacagtgcaggtcctcatgcccacctgacctggggtgtaatggaccacacaccctgatgctcagagcacatctcttgttgaatgctaggccctggatgactggtcctggcccaaccccaggagtttagagcctcactagggaacaagactgggcatgtactacctgtagcatgaggggctggtggctgtgaacaagagccctgctgaggggagccccagggggacaggttcaggtcagcctactaggggagggcattcaaggagggcctcccagaggaggtggcctttgtgcttcagcccaaaggatgagttggggaatgctcagcagaaagaggcaggtgagggctgggcatggtggcttatgcctgtaatccagcactttgggaggtcaaggtgggagaattgctagagcccaggaattcaagaacatcctgggcaacatagacaccatctctgaaaaaaaaaaaaaaaaaagagggcaggtgaggttatcaggcctgggtgggtgggaggcaaagcctgggagctcagtgggggcctgatcacatcccagagggccttgaatgccgaatggagtttatccttgactcagggtcaacaaggaaacattgtggggtgaagagtgctgtcctcagatctgatttgcagaccagtagctgcagtggctgcttggaggatgttctcacaggggtcccatgatccctgctgcgttccaggagagagggcatgaggctcattgctggcaggggcctgggtatgggccaaacagtgctgcagatatcatgtggctggtagggggtgaggatggtggtcatcgggggcactgggtgctgtggtatctgaagggagtgatttccaagtgccgtgagggtgcccttggccctcagggcttttgcacacagcatccctgggtgcctgctaaacgtgcagatgctgttctcaccccagcacagctgggccaggtgcatttagaaacctggctgaaaactgcaggtctgatgaggagcacaaaggtcgggtccctagagaacaggagcctttgaaggaagagggtggagctgattgcagactgccgaatcttgaaggggtccacagaggggctgcagggtgtggacttggctgcagcaaggagagaggaggaccaagctctccccttgatgagtaattcagcatacagttgaagctctttgcagtaggtgtgaggaaggcaagatcttggcactggggatgctactgattgtctaatggaaggggttctcagcacaggcaaagggctgagctcactgtgctggtgaagggggcaactgagtaagtcctctaggatgagggggaagttcccagtctggaagtgagggaaaaacatctgaggcagagggaacagcatatgcaaaggctcagagtgctggggggatgctgtcagaggggcacagctcttgaagccaggccagcagggatggactttgttcctgtctaggggcagcaagtcagccaggctttcttctctcaagtcagagaagaaaggccagggctactggatcctggaatgtgtgaggtccttggcccagtggatgtctggtggccttggtgtatcttattggcacggccacgttcacaggacccgtggggtcaggggagggcctacttgtgcagagggaggggtagtctctaggtaggcaactggcacctgcctccatctgggtgaaccagggcagggagggagggaggcgggtggccaggtgacggccgtcctggcaggtgcgttccatcatctgccatgaagacagccgtggggcctcaggggctggagctgtttctcacactgtccccgaccataaacacacacactgagattccaccgttgtccctcccctctctgaggatgtgatgtgaggagcagctgtcaattaccatcagctgccacaatgcagggaggcagctgaggaccagatagagcaggagtggccagctccaggtcacacggcaagtgggacctccgaccagctcccagcctccccatggcaccagggacctcacgtgggtcaggatctctccaccttctctgtaactctggctcctgctctcaaggaggaagagctgtcccctagcaataagctcttcccatctggagtcaccagcttgttcagcttttcctcacctccctccacctacaaacaacccaagggaacaaacccagaaagccaggtcccagcctgttggaccaggcctcgcccagttggagcagaaggcgtgcagtggggaacgcagcctgtagcccctctcacagggaggcagaaatcccggctctggaagtgtataaacacggttatttttagccttcagagggctgtgggcgcagcagcgtgacctgaatctggctcagccccctccttctgccccacccgggagagaaggcctcctttgccccgccctctgctccatcagcctcagggctgggccagtgaattccaggatccagggagagaaagaaatgggtgtgtgtgggggtctcagcaaggctgcccagggccaggagctgaggggggacaggatgtggttttcaaagaggcagcatttcaagttgcaacagaaatattggagccacccaatttcatgacttttccatgggttcttactccctaatcctggtcccttccctggtctggctggaggcgagtcccaggcgccacctgggaagcagtgctggcctagcaccaggcggccttgctgctgctttgctgccgtaggctaccaggcccacatagcacctctccgcggctcagtgccctcatctgagaagtgggatcattcccaacctggctggcagggagttgagggggtgatggtgagctgacagaatcgtagctgttcactcacttgttcattcaaccaacacttattaaatgttagttttatgccagccagtgatctaaacattggatagaaagcaggaaaccagcttgaggaggtgctgaccctcctggggctaacatcattgagcagggctggggaacacagaaggacagtaatcagctcgtagtacgtgcagtacagtagtaatgtcgagcgatgtgttacggagcggctggggtgggggaggcggcatgtattttagatgagggcagtctgggaggaccccttgagaaactgtaaaacagccagccactgtaggtggaggaggtggtgagcgggaacagcaggtgcaaaggcccaggggtaggaatatgcttggtgcccgagaactgaggacatggggaaaccgtgagggggagcgagcagagccagctgcacggggctcgagggccgtggggatgcctggggtggggggctgtaaacaggaaaagctttacagctgtaaggaagagcaggaaggaagtgagagtgggaggccaaggaggggctgttgcccccacccaggcaaaggagctggcgaggagtgggcagatccgcacgcggggagggtgaacggtggaaatggcagatggcttggttgagggggagcgtcagaaaccaggatggttccttgacttttggatttgatgcctgggtgggtgggggtggagagggcatttgatccaaaaggagggcggagggagaacaggatctaggggagggagggcaaggggtgatgccaacctggacacaggttttcggtgtctgttgacatcggagtggagaggggagccctgggggagcagctgcatggggcacaccaggccccaggctggcaagccctcctccctggggctctttgccagcccggagccaggctgtgtgggcgagtgcttccctgggggcctggcctggggttttgtcccattgcatcatggatgaggaccttccggtcccctggcttggaggcagacgtaggtggaggtgcagagtggtccacggctctgcccaaaaggctggacaagttggaaggtggtctgtcattcaagcaccatttgccattggctggatgcgagccctggtgtcactaccaaccttgttcccagctgggctgacttcttactatgaactagcaactatgaactagtcctgccactcctgtgcctggactgggatgggaaggacagcaggagtagcaacatgctctggaatttttcacagcagacctggttcactttcatctggtcaccagacaatgtagtgacccctcccctctctgggcctcagaatcccacctgagaccccaggatggagtagaaggtcttcagggtctccgtgtgaaacacagcctttcgatgacggagatttggtattgagagggtcatggcgtgagtaaaggcctggaggctggtctagggagtcaccttgcaggatcttggggagcggatgagtatagagtccgcgtgcatagaagccatgtgcagggtggtcactggaggtgaggtgggaacaccaggctgcctggttgggtcagagggaccagattaccatataagccattgtgctctcaggataatctcctggcttgttaaagcctcagttttgtcatctgcaaaatgggtacaatagacgtcactgagcttgcaggggtgaatacccaccaaggtacagagatgggccaactcagtgcctggtcgtaggatgtctttgatttccagaggttgccttctttccctgtctttctccagtttgtagccagaatccaaatttcaggggagggctcttttgctgttggggcttcctgtgagagccacagccctgggcctgggagtcctgccaaacccaactctggaggccgtgaacctcaccgtagccttggggactggcccgctggccacggcactctgagcatcagccttaggtactgctagtaggaggtgcactggggttttaaccagaggcagtaatgagctttctgaaatcatgccagcttcatgttttgtttctcaaagaaacgatgggccttgatttcctatcagcattgatgtggttgctgttgttgttgggttgttgttgtggggtgtgtgtgtgtgtgtgtgtgtgtgtgtgtgtgtgtgtgtgtgtcttaactgccatgggttttaaagccatggtggaaagtgaggaaaatagcagatgctagatccaattgccaccaaactgtcttgaaatgctataaatattttctaaaaagactagcttcccgagcccaatgtgttagttgtctcctccctgagaaactgattcccgaaaatttagacaaataacctcttaaatcacagctgttaacctcgggtgtaaaaactgctaccacaccagccgcaggtcacagcgactctgctctgcctaagtgcctccgtgtggcatagagaaggtggtggcagagaagagagatcttgtgcttaggcaagagaccagggtcggaagccgggcttggccactgactgctgtgtgacctggggccattggcccacctctctgagcctcttctgtgtaacagacctgttacaggctgcctcgatcctgagagtgccactgaactgagcttctttctgctcctcaaaggtaaacaaaagtgaccgttggcattcaggagttcatgttaatcaggactgagaaaacccctccgcccctagtcccctttagccctctgactgtgtcaaggacagctgccagtgactggatacttgctggtgtctcttttcaacagagagcacctgcaggacccggagcctccagcaggcaggcagcaaaacagtgccattgtttgttctccttgtatttgtttttgtgtttaacttctatccttggtgagtaaggctaattttgtatttaaggtagtaatataaagttcttttaaaaataaaagtatttatgcaaaagttgtgaattgattattaagctaatggcagtttcgatggcagaaggaaatgacaaacatcaggaagatgggaggaaatgtgacggactctgcacactgtccaggttgcccttcccctaagtgctcaccaacttctgtgcccttgtagaaggaatgagtggggaggggttgctggagggacgttctggtaaattgtcttccaattgcacaatacccagaggtgaccaccacactccctaagacggtggggctacagaaagccccattctggcatccgggccaaggaaaccactctcgtggagagtcttggccaagaagctgggattctgtagcaaaaccaaatccccccacccccaggccctctgtgcctctccattgaagttcccaaactgagggtctaagcttgacaccatctggctgctctctcctaggccagagaccaagaccaggccctagctctcccagatgtggctgaacccagcagaatgtagtagttgctccactaacagggacatcaagtgctgtaggttttgtcttatgctctgcctgagagtgacagcctggagtgctatacagaatagcaattctgaggctacaaggagctctgtaagagagcgtggggaccaattggtaatgcctgccatgggtgtgggaaggaagcctgggggtacacaggcctttatttgtgactcatatgctcccccaagcctgtggctagatcctgcccccattgcatcgccagcacccagcttggcgatcagtgggtgattgagcccagaagctcctataagaacttagcagatgctccttggccggtctttgcccgttgtgcaaggggacatcccccaaccacattgcaggccctggagggtcaacactcagcccttgagtttaggaagctcttgttcattccatacccactccctgctagggctggatatggggtaggtacccaggaagtgtgttgatgagacccaagaatgatcgacaaatgggactggagaggtggttcggcctggcttggcggcagtccatgtaacactacctcactacaggcatcgtgcaggtggccgagtgccccagattttctaggacagccctggtttcagatccttcatctattgttcttgagtgcccctgcctgaacaggcatttgggctccgctttggaagtcctggctgctgtggatatagccctcatgatcatgctttttgatcattttcagagcactcactcttccattgcctttgcatctggccaggggatggagcagccccatttgctcacttttttcaggtgaggaaattgaaggccagagtgagcaagtgactggcttgcggccacacagccagttaatgcagacatctggcctgaacctgtgatacccatcttctggccacttcactgtccacttacaaagcccagaactttctgcatcctgctatttaagcctcattcattcagtcagcttttgtagcctagcgggttagacctcaggagtcaaacagcatgctttgcatttgaactacttctggccgtgtgacttttggtgagttcctttctctctctgtgcctcagtttcttcattgataaaaggggtgtagacaccacacggggctcttgtgagtattactgggttaacagtgtctgtctcagggtgagggttctgtggggcccgccagtggtgttcacagaggtggattgatcagagttgctcacagtctggtgaatgtgaggtgggaggcagatgtgttcaccacgaaagagcgttcaagtggatgggtgaggtcagaggtgcactgggcaccaccgggcggtgggaggagggaccgtctccattgctcccacactactcggaggcattcagaaaggctcctccgttgatggacgctacttggagcagggcttgcagggggcagggagggcactggcctgatcctggcagatagcaacctccaaaacttctctggacagaggatggcactcatgcctaccgcctcactacctccagcagctggagcttctgggctctgctgtagggtggaggtggggttgagaagaggtgaaaagacccagttgctttgtcccaggggcaggcacagagtcctgcctgagggccctggcatggggtaattgtctattgttcatcgtctggtaagccagctccccaccttctttctgcctgcctgcctttctgtccttcctctcagcatctgtctatgcaatataaagagcccctcccaacacagtcaccagtgatctgcttccaggctagtgttgacatcccagcccacccggagacccatttattctgccactggggcacagggcccagttttaatcatcctcgctccactgtgagatacagatggttgtattattaatagtcataattaatcagcatccacagaggagcttttccctaggcagcagatcctcaggacgagcagccctgggaggtcccattccagtccccctttacagacaggggaagtgaggctgggagaaggggtggtgggactcatccgaggtggagctaggtatggaccccagctcagatctcagatctgataaccacctgcagtgttactgtctgggaatggactgttcaccccacccacccatacctaggtcctagggtgccaattgctgggagaagctttcagcactggggatgggagggtggtgctcaggctgatggtgcactttgagatctcaggctgagagtgaaggaagaaaggtgggatggggaagaaaggcctgagggaggccggacatattgggctagcaggacagggggcctgattggggtaagggtggggaggtggccttgggtagaaggaaagccaaataccaaccatcaccccctaatacacacagatcgtgggtcagggcctgaggttggctgcttctctgttctaagctctgcatcccagggacagtgatataaatgcttacagcaggcagcatcctgatttatggggctgttttggacgggcctaactacatcagcacagaggcagtgaggggcttcttgcacaattctgcaagcccaccttctcccctgcctggctcctggggctgaccaccaccgaggcccctgtgcatgcatgtgcacatgcatgcacccagacccacgcctgagtgggcacacccaggcccacgtgctctgtgtgcacctgaggctgtccacatccctgcccacagcccataaactgtgttagcccagcacgcaggtgtgtgctgctttgggcctgtgcgcagatgaacacaggtgtgcccaggtgcacacatgtgtgtgtctgcctgcactctgcaggcatccatgtgcctatgtcctctgggctgcctctctctgtgttgatctgttcgtggctctgggaggtggatgtctgttcgctgtcctgtgtgtgtcccagtgtggatgtgcattggtgaggggtgtacatgcctctgtgcaagtgcgcctgtgtgcatgggtctgtgtgcacacatgtgtgggcatgcaactgccgcctcatcctgtctttttcattatgggtgttgtccacactcacatccttgcgtgcaacacacacccggtgcccagcgtggctgggctgcccccgcctgatcattaggctcatggataagactctctgtcatcgtaaatgagtatagagtgccccagtccaggagtcctgaaggaactggggaggtagcctcatctgtcctcagcatctccaccccacctccatatggatggtgctggagaggggaggctgggagggagggatgtggtgcccactcccaggcccccacactgggttcctgatccaccctttgtttctccccaccatgcctatgcactcgcccatattctgtgccagaccttgaggacagccccgggtcgtgggagaagcccagtcaagagtcaggcagccgggtgcacaaacccaggctctgttgccagcatgtggccctagacagcccctctgcctctcccatcatcactgttttcccacctgcaaaatggtcttagcaatggccacctcatggggttattgtgaggacaaaaggggtgcagaaactgctagagaagtcaagttccttcccccagcagacctcagtctccccatctgtaagatggcaataatgaccctcaccagtggtctcatggagtgttttgaaggtcagatgagaaaaaggttcagtgaaggctgcagggtggtacccataggacttgttccagctgtgagcaaaggagatgaggggtgctaggcacttgggggtggcatgcatggcctgggccagatgcctgcatccaaacccccatgctgccaccctctggccttgggatgtgggaaggttacttcatcctcatctgcatctctattatccttagattcctcatctttccagcaggcatgttcgtagtagtatccatctcctggcatgttgggagaattcaggagaaatgagtgtggagcttagcacagagcttgacacaaagcagctgctcaaatcagcggtatttgttattcttgtttttggccttattgcgataccggtggccactcggtctggaaggacaggtgaatgcatggcggatggtgcattaataccacactaggatacctattaatgaggtttaatctgtgtttccagacttgatgtccatccgtcccaccgaagaagagttcaagcttttcttccagggaactgagagggccatgctgaaactggaagcctcagcctgcaagaggtgccctggggaaggaggtagttggtactgatgttggccgactacaaaggagctggctcctgggactctgaatgctgtgccctctgcagccacccagccccacaatgggaagccagtggttacatttacccctgtctcttctgaaccatatggtggctgcaccacagctggctcagaggctctgaaagaaggcccacaggggaacatgatgtcttgcctgagccaggtgaggactgaggcccccactgccaagcactgcagtctggggcttccattttcaccatagttcctctaagctgcctggaggaagggcttgaactcatgaacttcatgaccaatggacctgaagtctggaagcacagatgatacctcattaacaggtatcccagtgtgatatcaatacatcatctgtcatgcactcacctgtgcttccagatggggtggccactggcaccgagggactccttgcacagttatgcagatggctgccaatctacttgctccccttgcccagctcctgggctgaccaccaccggggcccctgtgcatagagcccatgagcagtccccatcacctgtgggcttcccagtctgtgcccaacttaatgatagctgttagggtccagtagaggatgcaatgtccccatcctagcaggggctttactgaagaaacgaggccctggcacccaggccagggcagggaggagacagttggtagacacagccgggtctgcaggggctcggaggtcatggggcccaggtgggcaggcaagggaggaggcaggccaggctggagccagtccttgaaggacaaagaggatttagctcactggaagggatggcattccagaaggacagaagtgtgtgggcaaaagtttggaatcattcccggggaaaggtgtaccctctcccataagaagtttggcctgccctggaccaaagagcagagtctttgctctcgatggctagtggctgtggggtgaagcagatggccagggggtgtgggtgacgggggaggcgcaccctcaggcctgagccaagggaaaccaagtgggcccacacaggccagagcctgagaccttggcaccagctactcggagatcttgactcaagagttaatgattcatttgtggccaattttctgctggctttgcctggaaattcccaagcttgccccttccctcaccttagggagctccaagaatacagtctcacttacacttggctgagaacgtctcacccactatccagggaatggtttttaaaattacagcaggtgtgatgtaggttagccattaggaaaagctgatcgggggctataggctgggagctggggtggtttgtttgagtgtttggaacaaatgtgaatagaattcagtctagtgtaaagtgttgtgacagttacaaattgggagctacagcttgacccagagtaggacttggttgggctaaaaaagtaatggcataggcaaaggccctggggcatgaacatccagggaacgctgagtgattgtggtgtggctggagtgtagagggtgtgagagacttctagaagtgtggacacaactcccaagtgaaggactctcaggacttgaagatttggcagtgggacgtgctggcagtggggagtcagggctggtacctgagtaggggacaggtgtgtttgatttgggttgtagggtcgcttgcccatccctgtcttgattctgctggtcagcagaccttccttgacagcctgctctgtgccaggtcggacccacgctctgcacgggtcctgcacctgtgtggaggctgaactaaagggagggggttacatgtagcaattcaggtgggagcatgggtgtgtgcaggagcaggggaatggctgatgacttcagacccactcggctccatcaccgaaagtccttgggtgagcgtagcagaggtgttggggtaggcttcaggaaccccatgttcctggcaggctctgtggacacgccgcctggaaaccacttctgccctgtaatatcagcatggctgaaggggcctggaatgtgtatctgtccttgtacagaggaggggagcagacgaggcccagagaggggaaggttgatggcagagcccaggcagaactcagggcccagtctcccaatcctggctgattgcacatatatcccaccacccacccgttcctgcagatctaaggacatttccccgaaaccaggcaaaatagagcagcctgattgtccatgtcaaaatgtctgggcatttggggagggagggttcctttatatctttcacaacttagcaaatttaatttcttctgattatttcttgacggtcccaggcgttggtggtaaacaaccacactccccagaatgtttccctgtgacagcagctttctctggcgagggtgctatcaacacttggcagggcctcctcctggctcctggctcccagctcctgagatcgtgagctcctgagctcctgggctcttgagcaaggcagcaagtgagggcttctcaacagctttcagcatgcagagcttgccctgtgtaccagggcaaggacaggcctagcctctttgttccccgcagcagcctggcctgccttcggagcctcaggtggcctctggttgtggatggtccccatgcagcgaggctgggtggtatcagatgtctgctggctcccacagctctggtgccgaggtccttggcatggctcagtggcaggagggagcctgtcttctgagcagctctgccaggactgtctgtggccgagagaccggcagcatcctgggcctgcagcctccatggtctgcgtcatactggcttaggtgtcctgagtcagagccaggaaatggatctgccatgcgggggtggaggtgctgctgcccgggcagctagggtgaaccccaacctcctgcccgtccacacctggagggtcctggccttgtgcttccttcccctggcctggcctgaatgtgactggtgcctggaggagaggctgaagttccagcctgctccacactccactttatgtgcccaggcccccaccccacaggctgttgttggcagggtgggtgctgagacacaggcaccacgctatgctgtgcttttgcctgagttattctattccctttttctagaatgccctttccaactcgttgtctgtgtgattttctgctccccctccaagaatttacacaagaatgacttttttggtgaaggcttccctggcacccccactctggccaaggctgcccccctttcctctgagccccctctccattgatggctcctatcacagtgtagtatattcacgtttggagcccgttcacctgtgtaggtgccttgaggcttttttctttgtgggtcctacaggcctgatgtgtagtatcagctcaataaaagcaggctggatttaattaagggggttcctgaaggcggtgctggagtctccctttgttaatggtgtggtgaagaggaggcgggagtttgcaaatggagagaggctgacttgcctgccggactcctacccccgatcccctctgagggcagtgctgcccctctgactgctggggactggggtggccccctccatttctatccagcggcagacttccctgcccggcaggagctggctccccaggttgccggagtgatcactctccagaaaacaccccagtggaaactgcatgaatgattgataagagctgagagctgtttaattttttccccctgtttaatggctatcaataatttaatacgctctctgtatgtttttaagaaatagcacccatttcgccgtctccggtttagcgggctaaatgatttaagtgttggaaatgtgctctgaggatggaggttgagtgagtcggagaaatctggaggctgggagtgggggaaggcgggttcagagccagccacagcatcttggcctgggtgtgtatgtgtgtgtgtgtctgtgtgtgtgtgtgtgcgtgtgtgtgtgcgtgtgtgtgtgtgtgtgtgtgtgtgtgtgtgtgtgtgtgaaggtgggagggagaagggagggagggaaggggcgggtaaaagccagctcctctctgctaagagcaagataattgcttttccggggcctcactgagcagcagctgaacagctgtcagcacccccctccacaaatgctaagctttttttctggatggctctggggggcccaggggggctaggaaggagctgccaccagtatcaccacgggctgagaatctccccttcccctgacatctttgccccctcttaaagcttctaaatcacttttattttaacgacgcagtaaggctgctgcccgggtggtgtcttccaggtggggtgtgggtggtggagtggagtgagggactcagagggacctggagggtcatctgccagtgctcccccaaactttccagatgcagagcatcacctgggaggacttgctaaaaatttaaatttctgggctgtgttccagacccatagacttccactcccaggggaaaggcctgggaagttgtgggtttaacaatcagcccaggtgattcttagcagaggagtttgggaactatagagtccagctctgttctggtgcttacagcacccacagcaccacgtggcagctcccttctgcttgcatgcctctgggaatgaggtactcaccacctcccaaggtagcagacccacttgtggaaggcatactctagtctagagttgcttctgatgttaggctgtgacctacccagctgcccttgtgggcttggagttctctctgctacaggacagaccgtgtttcctgggatctgatgtctttccctctcccagccttgccactttttggcttgtttgggcctctctgctgggtaaggagcttcctctcttagcaaagggtcctggaggtagaaggcaggaaggtgacaggtgctgtggcctgtctgtagtgtgtgaggtggctgcatcatcctattgctggtaagcatcatcgctggtacagtggagaccctgaggaaggcagaaagatggtgggcctcagcactgccttggcctgtcagggattccattcctcccacgagagagaaaactggctcatcagagatcgttgtgtcagccatagctcttagatgacactggggggaactgagggctgaggggtttccccagagaccacatatctatttaggacagagctggagctgcaaatgtgggggcgagaggcccttagaggggtggccaggccaaggccctggctttagggatcagctgaggccccagccagtcactcacctgaggttggatgggggagggcttccgccttctcagtcactcagggctgatggacaattcatggagtcaatacatggaaggattttggtggagccgatgcccactctgtctggcattacaactcttccttctgtctgcctagcagtttccattgttttgccagagggtgtagcattatactacggccatgggtcttgcaattttgttttaatagataattaagagggaaggagtggtgcacatttactgggcatcatggcttactgtgaaatggggagtataatccccccgtaagccctgcactctgtagccccttactgcacccccggattcagccccaccctccatctctgtgggagaagcctgggtccccaggagagaattgccctgttgggtgctggcagctgacctatcttgagatcccagttccccatcctaccctgaagcctgctctggccatcacagtatggctgggggtgtctcgaccctgggggaagaggagtaggggtgtcacccaaccctgatagagcttctgcttggagaactccgagagctgcagaggcagaagagagacttacacactctggggaagacccagccccagagagagaactgtgtgaatatggacacccaggcaaggcctggggaggtcagggagggcctccaggagaaggtgccacctgactgcaggcttgagcatggtaggaaggggaagggcatcctgcggtggaggtgtgatgcagcctgtgggggtgcacagaagagtgaggtagagcctgcagggctggggatgggctacagaggccggctggccagggcggggctgacctgattcagttgggtggaaagccacggaaagatttgtctttagttccattgaagtgttacacccatgcagaaaagtgtgtatctcctacatttgtagcttgacaaattatcctgaagggcacatgcttctgtagctgccaggcagatcaagaaacagaaccttgcagacccactagagccccctgtgccctctactcactgccccctcaaggataccgactgtcctgacttccagcctgctgtgagttatctcctgctgcccagcaaaccacctgaaaacttggtggcttaaagcagccaccatttatgaaacctcacaattctgtggtttggctggacttctcctcctgattcgcttgggctcatgtgactccagtcacgtttgagtgtctgctggactggaaggtccagatggcctcagtcacacgggcagtgggtgctggctgttgccaggggagttccccaccctccactaagacagacacctccctccatggcctgcagcctcacaagagaggcaaggccagaaatggcaggacctcttgaggaggcctagtctctataactcacaaaatgtcactcacaccgaatcctattgatctaaacaactctcaaggccagctctcagcaggtggagaacagactccgcctcttgataggaggaactccagaggacccctgccgtatttcatctattacaggtgtagagtctttttgcccttcttgacctttatataaatggatctcataagtgtattctctgtcgtgcctggctttttgagtcaacattgtgtttgcaagatttacccgtagtgttgttggatgaagttgcagatcactcattcccaagcctgtgcagcagtttgttgtgtggaaacaccagttgacccattctatggttggtggccatctgggaagttttcattttctggctgttacgaattgccttgctacgagcattctaacacatgtcttctggtgaacatatgcacatttttctgtggacatggagttcctgggtcatgggagaggtcacagggtaagagacccttccaaactattcttccaagtggtgggtctagtgtctagtgtgtgccccaccagcagaagggggactttacaaagacccagctgaagatgggctggaggtgcatcttgtggacactggaaggggcttcctgtgatgtcccctctgcccgccctgagcctcaggcccccaggtcaggggaagtagagccatgaggctgatccctcttttctgagcatgagctttcctgctacactttttccaccccagaggcctcctattgccttctccttttcccagcagctgcctttcatggttgacctgaccctcaacagtcagggaggccaggggtctgcagatgcaggaactggggggagacagccacacagcctccatccctgaggagatttggacttcactccagccttgcctttcaccatgggaggaaccctttccctctcagggcctcagtttcctcatttgtaaaatgacaaggaaaagtatcaacctcaccaagtccctttcttctcatcaatctgaccccatattctagaatcgaatagaggaagggatggggggaggcctcctgacttcagtcagcccatgtttttctgtttgttcactgcacactttcacggcaccattcatccatcaaggaatctctgtggtccttgttaaccagttcagaggacagagagaaactagacttcactcccaatgtccaggagctgggcctggagcgggagagtgtcctgtgggaagcgggaggaggcaaggttggccaggcgcacagcccactggagatgaacaagcaaggaggggctggtgagagagggctccacggaagcacttgagcagagtctcaaaggccaggggcccttgaaagacagagaagtggggagaagagctctgagcggggcacccagcgtgtgccaaggccggagccaggggctctgggaggccgggctgactggagcctagtggtgggcaggcaggtttggctgctgctgtggtctggctttcagggctgcggggctgctcggccggtgctggggcttcgaatgtgacgttcaggagctgcgacctttatttggcagtggcaggacggtatccagtgtctcgagtagctccacgttggtgggccagttccatcttccaggagatggcagccaggacctagaggtccatgacgtgggtgaggggctgcccgcagggtcagagcttggagctcactgccccctttcttgtctcccataggactcacggcagctgtgttctgatttcgtactactgctggggctgccacctcctcctccagacgctctcagcagacttgagtcctggtccttctgcagaggcctgagcaggtaagtgggatgggctggccctctggtgctgtgcacctgctgacgtggggcagacagggagtgcgggctgcccagagtgcatggtgctgtttcaggggcccagagggctggggaggggaaggggcttctttctcagtctttatttgttccttggccttttcctctcaaagaaagccacacagtggagggtggtgaatgtcctgacttgggacctggacatgggattttattctgctgccaactcccagtatcgccttgggtagccctttccttctagagggcctcagctttctactctagtccatggaaataacagtaatgatatcctctaacccgacaagcacttaactgtattctgggtactgtgcaaagtactatagagttattacttctttcagcatcacagcagccttatgagagcattgctgtaatcaccagcattgtacatgtgagaaaactgaacgtcactcactcaggaagtaacttgccccaggcggcacacctggctgagcctagggttcaagtccaggtctgtgtggctccagtgcgccagccactgcccgctggcctactctgcctctggccttgctcctagcttctttttgggggtggggatcagggcaattatgggtgtcttcagaagtgccagatcctgtcccaacttaagaaaaagggagaggggcttttaccaggtgacaggctcctggtgggtctggggtcatgacccatttgtgatgtgatgtggcagggaccaggcctggcctctgggtgcctctgaggtggcagccagggccccctctagaggaggggtgtgtaggctggataaggctttctttccctccgcccctcaagttcgttttcctaagcttgtattaaacacttactgtgtgccaactcctggattaggtaccaactgcggtgcaagggaaaggggcctgtcccactctctgctccgtggagaaacagaaagatcccagtgatgtggcaagccccataacagtggcgtggagagggttcagaggctggggggagaattctggggaggtgaccacaagtgagttacagtgtggggagacagaagcatagatggagcagaacctggcaggatgtgcatgcacacacagacatgagtggtggtgagtgcatagataatacagatgtgcaaatgtgcgcttcctcacaaacgtgtacacagacgtcgcttctgcatgccacatgaatgcacacagataacacttgcgtgcacttgcatgctcacatacacatgcacaaactcgtgttggaactacacacatacacgggcacaaactctcacaagcacacagcattctgacacacggggctgcatatccatgcacacacaacgcagggtgcattccaacaagaagaggcagttcagaggtcgatggctctgcatcggcaaaagcttccagcagctcctgggaggctctggacagcctgggccgaggctgagctggagctctgtttgtgtgtatgttggggagggtgttggggcttgagggccagccatgtgactgaccatggacaagcccttgcccgctctaggactcattccccatctggaaacaggaatcgtccctgtccgcctcctatacggtggccgcaaggatgagaggctgctgtgtagattgccgagagcaattttgggcactctgcagggcttcaacaaattgaagctagtagtctcatgagaataaaacaggttacaggtaaagtggggatgtgggggctgttcctctccaggcttctcatcccctggggcctgggtactctctgaatcatgggcatgacagtccaccctgcctgcctccaccaaggtggtggggtctgtgtcatccctgctcccgctctcccacctgcacttccctgttgactcgtgaggagttgggggcctgcagtgcccagctttggtacaacaaccacatttgactccctgccaggagactggcacattgcctccatgagtgctctaaatccccttgagaagcctgagaaggccttaccaagcaatttccagatgaggaaactgaggcacaataaatgcaggtgaggttctcagggacacctgctcataagtgttggagctgggcttcggatccacgtcatcagatgtgaacatttatgctcttttctcccatgatctcctctcagggataggtcatttattacccactttgcagataaggaaactgaggctcagagagggcaggccactcagccaggaagtagcacagccagaattgggtgcttattaaccacactgcacccacctcaattcaacacttccttttcctttccctccctccttcccagagagcccctccaggttagagggggttcccgaggaggcttctgggattatctgggctttagttctgacctagtattcccaggcatacctgccattttcttgcaaatagaaagataggctattctctggggtctgctttctagcatgacctagtaacttcctctccacaactcctttgtaaagtatccttaggattgtcctttggaaacttggccagcagaaagctctggggtacccaagaggcttggaggagtcctaggcctttggagaggtagccactgcttgcatatccactgggaggctctgtgacctgctaaaggatcagggtgtgggaccacagcacagggagccaaggttctgcttggcatgggtggtaggtaccactatggaaggaaattgggaaggatccccgggaggtgatatttacgctgggccttggaaagaggagaaatttgctaggttgatgtcaaaggccaaggaagacccagcagaaggctcagctccaccaaagtcccagaaaagtgagagtttattcatggcccttcgcacctgcatctgtacccaacaatacccatcagagtctcctagaattagggccagctaaataatttagctgtggtccaatgctaaatgaaaatgcagagccctttgttcatgaattacaaaggatttcaagatgatgacagcagagtagggtccttctaagcttgtggccctgtgtgacggccagtgaagccaaccctgcttgagtaagtgtagcaattgtgggatttagcgccaagaactgagttcacgtgcaggcgccaccagttacttaccaggcccacgaccttgggcaagtcctcctcatctccgtaagcctcatctgccaatcagcgatggtaccctcctgcctgcagaggagggtcagtggtgccagcatctagcttatcccaagcagtccaggacagaagctttggccggggtggagtggcaactctttccgtcacgtagtgatgttcaaggctctcctgacccaccccatttaccttccagcgctgcccctgtctaccttggtggcctggttttttgtgcttttccaaatccacctggctgggcagtggagggtatggggagtctactctgttttatttgcagagcctcctgtctggactgctccttgcccacactcccatctctccttggcagactcactcctgcaggttagatgtcatggagatttctttgaccccccagctcctcccttccaacctttactctgtgataccttcagtagctgcaatgacctcttgcactatagagttctctacagtgtgcgaagtcctttcacacccatcacaccctggagagctcttgaaaggccctattcccatttgctagataggaaaacagaggctcagaggtacaaccatcctaagttcctgggctgaggtcagacccacatcgggtaggggtgtagacagtggcagcagagaatggtacctaggctccaccctcggccgcctcatcttgcagcatttgggaaaactggcttttcccttctggtagaaagctccagcccctggcccaggagaggtatgtgggttgctgaagagggcctggtagagcgcagaggtccagccagctagagcagactagcgcccagccctgcttttccccacaagtgatgtggcccagttcacgtggctcggcggactagagccaggtatacatggctctgaagtctggggcagaggtgagaaggccctagctggcctgggctgcaaccgcaggcaaaggctggccacagatgagaggggtatcgtgtcaggggcatgacaaactgttccatatggctggcacttcacaaaagacactcaaaacactcttggtggatgagtgtggaggatgctggcagattgcggctgtggaccgggctgaggcatggaggttttccagctctgttacccctttctttgtggcttctgatgagcgacttcatctctctgtgccccatttcctcatctgtaaaatggggagaatatccctctagttgggagggattcaacgaagtaagccatgggcactctcacagccatgcctggagcatggttagtgctttctggcactttctagcatgaagagtggaggtggcagtagcgggagtgagtagggggtggactccagggctgtggccacacaggagggtttcctccactgagcagcatggttgtgcggtcttttaagagaaggtggagagggagatcagggattggggttgggctggatttggatttcatatgaggcaatcccaaacagctgttgctcagagctctgtgggcagccacctggggtgagggctgcactctcctcgccagcccctccagcccctggtgtgtggctttaggctgccggcatgcacaccctaagttgtcagtcagcagacttccagggttacataggcggtttggggctggccatgaagaccttgaatgccaagcccagctcacagcaggcctggccagggcccagcccgtggccacacggagctgggattccagggtccgcatatggcatgcctgtcaatcttcagcgccagctgagaatgcacacctctcctcccactgcgtgaaatctgtggcctgcagcccaggccctccaccccagcctctgcagcctgctatgactccacaacccccacccaagcctggatctgggaatcgtttgcagctcactgcttattcctgcccaaggtaggatgcccctctaggtcaggagggtgggactgctgtcctggtgggccctctgagcaggacttgtgttcaagcctcagtcccattaagaactgctgtgtgaccttggacaagttgctgcccctctctgagcagctgtttattggtctgtaaaatcagaggattggggtaggtcagggattacaaactgcagtcttcaagggtgtcaacaacccattgaagttgggactatcctgttgtacaaatgagaaaactcaaagcacagagaggttaagaaacttagccaaggtcacacaggttatagtggagctaggactcagcccagttttatctgacaccataatatgtgttttccctaccacaacaaactgcctgtcacagatacttgcttgtttgctgggtgatccattttgtccatcagccagcttggtgttgaacacttccttgtgctcctgcaccgtgctaggccctggtatccaatagtgaatcttcagttgagctgggagagcacagctccaggtccggagttctgagtagaggtcacagtctccagtgcagggttgctaggtaggtgcagctctttcctcatgctgtaggaggcagccagagaagacttcctggtggaggggtaaggggagtggggttcctatacagagtggaagagtagggtcttcctggggtctctgcacaactgggtggcatgggtcagggcagtccggctggggaggaagattcattcagccacagctgaggcagcccctgagggccttgaatgctaggccacagagtttggccatgaacctgcagggagtggggagctaaaagagactgcagggcagtggcacctcctttgtgagagctaggagggctggcctcagcttgcaagctagggcaagggtgaggtgtggtccagtctaagacttagttcacccaggaactgtggcagcaggaagagcaaggttggaggcttgtccactggccggaccttcatgctccaccacggcctcttcagcaacccaggcacctctgctggaccaggcgctggggctttctaccaaaagggaaagccagtcttctcaaatgctgcaagataaagcgaccgacgatggagccaggtgccacaatctgcacacctcccccaaccccatctgccatgggcctgacctcagctcagagcttggggcaggcgttgctcagtgacacagtgggatcagagaggctcagagaccagcccgggggcacacagcattcctcatggtgggtacagaggctagagcaggtaggcagcatctttcccaagagaggtaggtctgggtctccctctggccgtcccagggtcctggacatgcttcatggatggtgtgtgctcactctggtaggagtgtaaggttgtaaagagtttcctgggtgttacttactgagggcgcttctccctcccactgatgtttgccccactggctctttttgagctctggagtttgtctctttctggttcatgagccacacacccaggccacacattggggcagaggacagccttggccgtgcctgtgttcctaggtctgaagcctcagcgaccttgcagcaagtaatagacactgggtggggccacaagcgtgacatctttattggaataaaaacaaaaccacagcctctctctcgtgttgggaggagtggtctttagaaatcattttacccaccccactcatggcacagatgaggaaactgaggcccagagataggagggcatgccccaaggtagccaacatggcgcttcaggctatcagctgagtgcagggccacactaaactgtgtaggctacatgggggtgcagaggctggcaggggcagggaccagcagcagcgataggagccttctatctgcagaaaggcaggactgaccctgaagggccaaggaagctctggggacctgtggagagccacccagaactgggactgagagctgcacgggaacccgcagacctggctccgtggagccgcatttgtgttctgcctcctgctgtgagaggttcgccaccacaagcaagggcttatcctgtcatccatttacccagagagccccagtgaggccgggatttgtaggcccaatggtcagggctaggggcaacgcctcagagtcagggcctagtgtgaggcttataaggggcaagggagtgaagaaataaagtggactcaggaaaccaggggctgcccttcccctcatcagccccctctgccaaggcttagcagagtgtccagcaggctcaaccatctgggaggctgctgaccacaggcagcatggcattacctagggccagggtctaggggctctgaaggcctcaggggtcagggagagcttcctggaggaggtgagtgccagctgagccccaaagaatgaccagactgtgaaccaaactgaaagcattccacgcaaagggaacagctgggccaagaccctgtggcagccacactggggcagataatgggggctttgtggaggctaggactgctcagggaaagaaatgaggctggaggtgcccccggggggttggagacggcagaaggaaagaaggttatattttgcttttaacttgctaaatgcccctgagtagatcactgccccacttttgtgcctcagtttcccttttatctcctctgagcttcaggcacctggggagccacagcagggaagtgcctcagtggaagagtccgcttctggaggctttgagctgatgctggggatatgagctgagggaagtatgggcttccccagcacctcgggggcagttggcccagaaggctgctgctggacccaaggcttctccccagtggaggagagctgacctaagatttctggggtttgccaggctggaccaacctgagaggatgagggattaggtccctggggcagcccccactacagactaaggacctgggtcccaggataaaatgagagatgcgcctcccttctctttgctgtgaccaactccttctttcctccttctgcctccttccctcctgctggggacagggaggggacaatatttattccttcccaaggctgcagctgactgataccctgatgcagaggaaatgccatgccagtgccaggcatgctgccggcgctctgggtgcctggtgccctctccaggtgtggctcctccccatagccctgggctcggccggtctgtgtttgcagagcctccactgacctgcagcggcctctctctcatgcctctcctatcagcagagcgccagccatgggctccttggactacaagtccccgggattgcgcaaattcccccagcagtttgcacagcagccagctcaggccccgtcagatggcccaggttcctgctcgggaagcccattcttttctggaataataaagcagccaccccacagcagggggtggcaagcttctcttatcctcacaacccctgactcatgtcaccctcataatatcaagtgggctggggcggggtggggaggtgggtggcgttttccagagggggaactggagtcagagaagagaaggcatgagacttgaccagggtcacacggcccagccaggactccaaccaggcccctgctcagcctttttagaccgagccagtgtttcctgttcagggccatgcaggaggtgagtcaggagcaggccctttgcaggagctgctgggggccagcaggagaggccaccagtctctgtcttccctctttggctccagctgctttaattggctggggctgccagtggcgctgacatttacctggtgggaaggagggcctcctccctcttgaattgagatgctaaaaataacagggcccagcttcccagggccactgctcagccagcgcctgcctgccccctcagctacctttttcctgggtgctggaagctaattgctttgcaagcatgcagttccttgcgctgagaacttcctagggattgggacaggaggcattgcatgctcagcttctgagtctaaagaggggtctctgcaagacctccctcccctccaggcagcagggtgatggtcttctgcctcaggtctccctcccccttttctccctgggtgcagtacctgtccaggttgactactccacccctaggtgcttgggtgccttctttgagctgccagagtttcccctgctctaagagagggggctctgccctccttggagttttctagtactcacctctccctgcaccatactcgacccagacatatgcggtgtggccctctgccctcatgctgttcattttgtcataccagcaaccaagaggagcccaggcttcggagctggacaagtttaaatccagctgtgtgaccatagcacatttccaagcctctcttttctcatctcagaaatgggcatgaatctgacctttgcagtgttgttgcagaatgaatcgcagtgggcaaaacatgcctgatcaagagtggagcccctggggccaggaggaggcgtgtgtacatcatggggcgttcctttctcttgctgtgtaaatagaccctggaactcaaataaattagattgattggaccagaaggggaaggtcttgaagacccaggctaaggattagggactcagtctccctgaaaacagggtatgcttgccaatccccagggcacctccagagtggcctgtgtgtttgtccagttcttgccctgggtcagtgtgaccataatcattttgacattggccagcatctcccgggctttgggatcattccagtggaaaaagtagttttcagtgctctatgcttggcaggtgtgagagcctgggcgtgcttaacccatccacacctcaatttcctcatctgaaaatggggatgataatacttccttccccgttaagtattgtaaggattagattagcaacatatgcacagtacttagaaagtctggtgcagggtaacacttggtatgtgttagctggtactcatagtagtaagaatagtctagcagttgggagtaataacagcagccacctgccgtttgtttaatggtttttatcagatgctgtgccggatgctaagcactttaagtacattatttaatgtcactctcccccacctcccagcaaccatacacaaggtactgttataagctctgagttccagatgaggaaactgagacacagagagtagttgaactgaaaaccagagttcagcatcagccccactagggtggccgtccagattgcctgggaccgtcctggttttagcatggaaaattctgtgtcccagaaacctgtcacttgtgggcaaaccaggatggttgaccacccaaggcctgcctgagtccactggccccactctgaagcccacaggatcctcttcttggcgcaggggcttgctggtgcagtcgctcggccccttcccacacctcataggcccctcccccagccagattgtgcctgcccatcccccagggcctggctccagtctcctctctggcttcctctcttccctcccctctgccagcaggaggggcatgactcatgcctggtgggctctttgctcaaggctgtgactgcagttgtctggtggactctgagctgcccctcaccaggcctcagtctccctatttgcactgagggctttagtggctttgctcccagctttctggagacgttcaggaaacctcttccttgaaagagggagggcagagcgagcccctgcccccagccctggcctgagcagttgggagggatcgcactggcccttccggtgcattgatggagtgcactgctgacaaaggagaaaggtcagcagggggacagagcggagttggtggtggcctgctggcctgcagtgccctcccacaagatagggcttcctgggggaggggagcagtgctccctgggctctgggtcaattcatattgatgcaggcagctgctggttcagcaaagctgggcatccaagcccccagagggctgcggggagatgcctaggtcatccttgacacctcactttccctgacccccacatccaacagttgattaggcccccttaaccatctctggatctgtgaccctctcagcatctcacccctgctggggaccatcttcctgcttctgaatccctgagccctttccagccctccctggcttcccccatcaccttgcataaagtcagaattttgaggctgacattaaggcccttactgagctcagaaaggctgcccagagctgcccaggccttccctaatatcagccttcttgtgccctccaccctccaaccccaaggtcatgtgaaaggtctggggacaccctgagtgccaggcccagcgctgtccagtcaacactccaaccctacccagtatacagggctgagcctgcagcagagctgcagccaggtgccaaatggatgcagtgcccctgccgtgcccttctcagactcccccttgagctgctgccatgcggttgcccagtggatctcatgccccagctcccagagggcaggagttatctgtctccccagcacacatgcagaccaagatgatggcaggaaagcgccatggttggtgcataggcgctggggtcataatatgagggtctgattccggctccatcactgactaaccgtgtgaccttgggcagtcacttaacctctcggtgcttcaatgacatcatttctgaaatgtgggtaataatattctgtccttcacaggatagtgggattcaataaagtgacacttatgaagtgtttgcagggtcccagaacattttaaggatcagtaaagtgagctcccatcagtcatcatcaggcaggtatctatgaaatgagcaccgtcttccaaatggggccctcccagttctttgaagggtccttgcatttttgcccggattgttccctctttgtcttcctcctgctctagcatcccgctgcacccccgcctgacatctcctgagactccaggaagccagcctgccctagccttgcattcttgcctaatccaccccattgccatggaatgccttcaggctatggccaggagttcttcccatgtcccccacagctctgcacaggttcatggaccacagtggatgcctaataagaatttgttgggttgaaccgatattcaccaagcaaagtcacctccaagaacaatgcagcaatgaccagccaggcctctgggcccatccacagcccattgaggacatttctgagaccagtcctgagctactctgtgcaggagaacagcacgtgcccactctggcctcttcggtggcgggggattggggataggtgggggtggcactggggctcagcagccacactggaaggtttttcagggggtttatctccctcttctctgagctgtcgtgcctgttttgtttgcctcggtcccttccccacccccacagttctctgttaaattgtgttattatatttaaacaaatcaattccattgcagagtttttcctgtcctaatgatgagtttgcagcacaaatgccattgatttctcacagccctgaaaaccagttgatgaatagcaccaggcttgtctttggagaggcacttagagcagctctgcatggccccctctgcttctcccctgtgctgtccccctcattcaggaccccacctccaccccacactctgctgccccctgagttggggctgaagtcatgtgataaagggagaccctctgtgctggccagggctggaatgtcatcgcaagggcccggcccctgttctggtggaacaatcatagtggagatttgtattgattttggccaaaggcacaacttacagagcagagaagtggtgcggtgtgatctttgtcttcccttacaagttcagagcgcgttcctgagagtgatggcagatagcagctcagacaccatttctagaccttgccagggctgctgaaagacctttgagcactgctgttttaaagggaggctccagaggtttgagagctgtctgcactggggagtgtaaaacttccctttgtgaaatccttcagaacctgcagtgttcaaagtcacggttaaaccactaccctgggctttgactttcagatcactgccacgtgcacgagcttctctgagctttctaatgaccccggggcttgggtgggcaggtaatattgttcccctttagaggccggcagactgagtcagggtagtcactggagagagggaagggctgcttgtccactccaagtcctgagtgcagcagtggctcccatgtctcctcctacaagggtaatacatggcaggggagctactctgatcaccagccttttcggccgggctttctgtctgtctgagcccaggtcctcgtgcaggtgtctccactcagctgctgcctgcagcataccacacaagcctgtgtattgggctggagtgaggcagcagggagcagcgaggactgtggcattctggagagtgcctgccccacctaaattcctaaaagtttggacaacccatgcccgtaaaagtatactacatgggatgagactgggggccaaatttgctgcctctcccctattctaattcaagcctttgttttggagactagaatgtgtggcccagaattggaaatggctcttcaaggtcacagcacaaagcagtggtgagctggggtttgggtctgggagaaggcgatgaggccccacagccagtgttctctcccctccctcaggcttggcgaggcagtggggtgggggcagggccagggactgtgttctagggaagatgggcccctcacccctgagttcaggggtagctcagcaggccccacttcccttttttctcccttcctccttccctcccatgcagacagacctcctgtccctgtaatcaggttagcctcctgctccgatgagctggaccagctgcctcttaatgacctgtcgacctggccccctcgcaggctctggggtgggggaggggaagctaagaaaagaacggtcggtggaaagaggctgtccactcccttgattcagacctttccacagcttctaggatcaagtccaaacccttagaatagcatccaagaccctgcttgcttctccagcacccaccccctagtacactcttttcctgcagtcacatgatgctgtttcctacctccctgccttttcacatgcaggtcctttggctacttcccaccttctcagaaaactcctgtgcatccttcaaaacccaatttgtgcctcttcctcaggactgcttcctctgggttcctgcctctgtactctcacagcattgggtgctctgctggtctggaacttattcccactgtgttggcctccattattcctggatctggtttctccggagttccgggaggaaaggaagaatattcccttccctctgcacctcaggggtacagcacagagaagtgctcagtgaaagtatagggccagcaaagaagagagaagtagggaccagggaagagaaagagacagacaagagtataaaaacagctgctcccagcccctcatactgccctagcctgcttcctgccagggaggccattcctagcgacgcatgcctggcctgaaatagacacatggggaccttggtagtgcattttcatagctcaacactaagcacccccctcccccttattccttgggcactgaagctccctctcctcccagggccttgcctctgcagccaagacccctcctccagcagtgcccagacctcacccctctgtttctgttaactttgttttataaataaatcatataaataggctcctctgattcctcggagcatgcagtgtttaaggactggggcattgccgcaggcataattgtactaccgaatccatcagctgcctaattaccattcattttgcatttatttctgctaattaaaaagagagaaactcctaacaacttttacataaatactatatttgttctatgtaaagatggatgctaatttgctggtgattagctgattatcggattttatagctgtcacacaggatggccctctctcccatttgtaccccggacaccacttgaggcccctgatcagatatgggaggaaggggtcaagggaggcccacctggggggttcgagggcctgtctgaagcccggggtcaccaggagcaccagatgccactggggctcagggcggggtagggggaaggtgctgcagtctgattggtggagctgggaggaacctgtggctcactcaccgcttctgtatagatggagaaactgaggcccagagaggcctagcacttcccagcaaaacagtgaccagggacagagtcagactgctattctagactggactccagtgcccatcccactgttgtatgctgttgtcaggaggaatttgcagggaggtggctttatctgctgctggagaactatgaggaccagactccaactcatgcagaggaaaggagcacttagcccatggcccaaactgaaccctctgtgtacccttctgaaaacctccacctccttctacttccctgggcagccctgggctttgccccacggcaccctgactgcacttagctaggctttctcccaacctggattgagacttccccaggactggccttgcaccctgtgggctatccggacacatgtgagggtgtcaaattttaacactatgtatgtatgttcatgtaactaaggaaaaaaatataattaatacatcaaacccatgatttcacagatcatagtgcttttgatgaggctaagtaaaaaaaaaagtaattggtttaaagtgatataaataattaaatagtttttttttttgagatggagtttcgctcttgttgcccaggctggtgctatcttggctcactgcaacctctgcctcccgggttcaagtgattctcctgtctcagcctcccgagtagctgggattacaggcatgcgccaccacacccagctaattttgtatttttaatagagaagtggtttcaccaggttggtcaggctggtctcgaactcctgacctcaggtgatctgcccgcctccgcctccaaagtgctaggattacaggcatgatccactgcacctggttgatacatttttaagtacataaagaattaagatggaatatggacacggcttacagtacctaataaggtgggttatttgataacttgaggagggtctgagaagaccaggtcaggaggccaggcagttgaggtcagggtcagcagtgacctggggcaaggtgggccaggtctgcagccaccactgccccatcccatgactgggcagatggtgccctcagattgtgcccttctctccccagccctgcagttggtcagaattagcccacaagagagcagtcatttgtcctcctaaaggtagtttcactgggactctgttgggggaggccaggaggttggacattaccccatttcccaccaagccaccagttgcgagtgtgtcacttcacatggacatgcggtgcacctgtttcccctggcattgataggtgagacactgactggcccctgttctctttcttcctggccaatctgaaaatgcccagttctcgagttaaagggataacagctttgacaaggccaggtgttgtctgggtggccagagagctaagggtcagggtcagcgtggcccattggcccattggagatccccaaggctttggggtccaagggccagggttccaggcctggctgctgcttcccaaagcgtcagtctcctcctctataagatggggacagttgtgctgaaagggttctgagggtcatgtgcaaagtgtccctcaaaggaagactcagtacagccggcagtgagcccagttccaggggccctctcggccacccacccacccgccgccgctgtgtctgtgccgccagagatctccctctcatcagcccctttatcgccctgtacacaatcaggggaagctgggaaggccgctggggctgagggcagatggaaaacaaagagagaaaacaaaggcactgctcctagggggccaaaaggcacctgcctcctcccccaggcctggccttggccaccccagtcctccaggatctgccccacccctccagaaggatagtctcagaactcatgtaggtcaccactctcaggggaccctcaggaagtcactcgtctccaggccaccttttcttatctgtaaaatgagagaattggacaacaggccatgtgacttttggcaaaccttccccctctccccaccctccagggtctccttggggcaggcccagctcgtctctaggaccccccagcctgtcccaggaagtcaagatggtgcccacttctgtctgtggcaaggaccccagccctgccttgggcagggtgaggtaaacaggaggcccctgtttcctgccgagatcttggggtgtgctgggtgctcagtgcatctgtgtggaatgaatgaattatttcatcagaagggggcctactcagagtcagccctaggttgctgctgctgttgaagcctctcagggaaggagacccttctggtcacttgagggaggtggagagaagtggtgaagggctggcaatggcatccctgccaggctgtctgggttcacatcttggttgtgtgaccttggactggtttcttaaccttctgtttcctcatctttaaaaattggttatagtactgacctcataggttgtggtaagattaagtggattaatttacataaagtgcttagaacagtacagctaaaggttaaatatcactatccatttcatcactcttattatgattagagggaggcttacagggaagcacatgaagattaggcatcctggcctctcctgggcacagccctggtgaaggctgggaattgctgggagctatagagtgttctaggtgggaggggcagcagtttgcaaacaggaacatttctatgtaagtatttctggtaaactgttaaacaggggcctcatgagaaaggggcatggattcctaagaatataggaatttgttgtgatttcttttctgattctaaatatatatttgtaatgttaaataatttttaaaacagggcctccaaaattgtataagcctcaggccctgcaacctgagctgttcctgattgtttctgttattgtgattgtatttctgtggcccagccctgtgctgcccactttggtggtcctgacaggatggcccagccttggggtcccagggacctgtcttctcaccctatggacagcggtgttatgtgcaggctggcctctgagctgtagtctacacttcacaccccagatggagggagctctgagggagcagacaaaggaaaatgggtacctcagggaaggtctctgaaggagtcttctctgcatatgcaggacacagagccctgtgcccagaggcttagtggccagccctgctgctcctactcacccggactaggtgtggcaggccaggcccctctcccttcccactccccctcggtatgtgccctggtggacaggcaggggcgggtggggccgtgggaagcaggctgctgagttggaacagtcacccctacagtggtcgttgagtggctggctgtgcaccaagcttcaggttcctgctgggtgcagacccagaatggtccttgccctctgggagctctcccggtaactgggaccacaagatttgcacctggaagggctaggggtgagcaggggaaggctgtactagacccatctctctccgagaggagacaggagagcccagaggtcgtgagggctggaccctgggggaggacctctgagaggacgggccctcggctggggggggggtgctcctagggtgggcgctgtgggccctggcgcctctgccagcagcagggcctctcggcccgggctctgacagggacatttataactcacagctgtgcggtcctgggcccaactgactgtggtaaaccgatctggcttcaggaagtcccgtcccgaggccactccccatcccgacccccacactctccttcacctcctgacacccacatcctgttctcagcgggaggggcaggcggcgggcactgggccaggggcccagccagggtctccaacctgtgggcagagtgggaaaggacagagagcagcagtgaggccccagtgctgcggggtgcccaccattgccagcctcctctcaaagcacacacagggaggcagaggcccagaggcagtgcaaggcccccaggagcccacagggtcagagcgccaagagcataggttgtagggctcaggggaatgttctgcgcctccagatctacctagaaaggggattcgccttctggcctctgtggacccactccagccaaaaggagcctgaccggaggggcagagtgaaccagaggcctcagagaatgctgggaaagacgccattttgggccctgggccttgggctggccctcctttgggacaccccgtccccaagatgcttcgtgcccatcccacctagatcctcccagcctagttcaagtgtggggccaaaaatggtcttgcccagtgctagaaagagagacagtactaaaggctgcagcacaccatggctctgaccccttacatcccttggcctgatacaatgaccagttcttgggccccatcagccagcccgcccctcctccatgcctctccctcttcttctgcacaacgtttgccaaagcttggcccaggtaaatctggtagtctacagcaagattctagaattagatagtacccaacaggacatacatttttgttttactagttacaatttattaaagagtatcagaaatatataactagcctatcaaatcaattatttcaagggcatgattgctttggacaaggccagatttattggagcttaaaaaaaaagtgagtggaaggtgaacattaaattaagtcatcacacaggtagatctcagctcagaccaagaatcctaaagagcgtggaggaagagctgaagtttggggagcacaatctaactcatcaccaggactcttttctgctttaaactctgcatctgggcctcctctcccagttataagcaaaacagccagccctgaaccttgtaggaggggcaagggagtgagctggttttcccgaggtgcgtacacacataaaatggctccgagtgttggtcagggatctggtgagcaattcataatgaggaaagaattcaggcaggggtcacagagtggctttggaagtggctgccggccggccgtgtgagataattccccgaagccaggcacggcgcagagaggaggccacggcaagggctttgtacacccggctaaaaatacccccgacagcttctccctgtcaccctgcctgggggccgtacaggaaagtgatgctgttctgcttttcctactaagaagagaaagacaacacaaagtccccagtcctggaagaaacaaaacttatatttatatatttttcaaaatcccactaggaggaattggcttgctggttggagtgtggctgggcggggaagacacagccagctctgataaatcaggcatcccggggtgtgcttaagtgacccaagaggccgctgagattagcttggcggcagggacagaggtgggaggggagtggacggcacaccggcctgctctcacacacgtctcatctctcccctgtgtacccaggaggaagaggaggaggcccgttggcgtcggaccaatgctgcaaggggtgtgaggagaggagccgctgtttttcactgagctgccataccccgaaaggtaacaccagcccccgatgcccaggccataccatcacctttgcctaagcctgggcaggggcaagccctagcagcccagaagtgctgtggctggaccagagctgagggttttcagctgcttctcacagcctttcctgggcctggctgcagggcctctctataactccttgtgtggtgctcatactgccagaaaaggcttctgggtgtcagtttgtctgtctccaaaatggggcactgggctcaggtcctgtacttacctcagttctcaaggattctgtgagtcagttgtgtctgatttggttgagccatcttagcagcctggctcagttggaactctagggctgtagccaggggtcccagcctttgtggatgctggattctaaggctacgaggtccacagtgccatgtggggcttgagaagggaggattttccaaagcagacctggctggagatgtgcttcactggggatgtggctgtggtctcctttgtggcagcattcaaaattccaaagttctccctgtcagctctgggcaagaattattatctgcattttcagaccacgagaacaaggcacagggaagttaatggtgcctgccagggatcacacagctagctctggccacgccacagcagcttggcttcatcctatttgccataccagcttctatgcttttacttcgaccgtactgcactcatcctctcaagagaagttctgcttttgaggccaagcaaccactagtctgtattgtgtgcctgtgagacccatccctccatccatccatcatccatccacttacctgtccatctctccatccatccctctttcttttagtccttccacactcatccacccattcatccctccaccacctatccgtccttccatccaactacttacccacccattccccccatccacccatctatttactctttaattcactcatcaaatattcatggactctcacaccaggccaggcccgcattaagggctggggtttttgtttttgtttttgtttttttgaggcagggtctcattctgtcacccaggttggagtgcagtgacacgaacatgattcactgcagcctcgacctcccaggctgaagcgattctcccacctcagcctcccgtgtagctgggactacaggcatgcaccgccacgcccagctgatttttaaatttttgtggagacggggtctcacttcgttgtccgggggtgggttttgaagacagagccaatttagccctgccctgagagggtgtggtgtgcaatggagtacgactcagatcccagagccagactgagttccataaggcagtgctcaaagcctgtgtggtgaccatgacgacacaggggacgagggagaggggacgtggctgattctgcaggcagacattcggggaggaggaggcggcattgctcatgcattcattccccaggtgttgaccgagaaagtctgtcaggaactctttaagttcagagatatagcagggaataaagcagacaaaactccctgcccttacggcgcttgtactctcgtgaggaggcatggatgataaatacctaaaaagtgaataggtcaggtgacgctaagttttaagaagacaaatttagccaggtaggagcacagagtctacagtgtaaagtactctttcactagccaaggaaagcttttttttttgagacagggtctcactctgtcactgtaacctcgacctccccagctgaagtgattctcccacctcagccccctgagtagctgggactacaggcacacaccatcatgcctggctaattagtgtacttttagtagagatggggttttcccatgttgcccaggctggtctcgaactcctggacttaagtgatccacctgcctcagcctcccaaagttctgggattacaggtgtgagccactctgcctgacccaagaaaggcttctgttaagttggccatttaagatagctgaatgcagccagggagtctgcagggatgtacttgacctgttcaaagaaatgcaaataatccagtgtggctgggaggatgtcaggatagggggcgaagtcagagagatcatggaggacccactcctgtaggcggacaagtgtggagcagagagatagctgggaagctgttgcccacatccaggtagaggtgatgggaacagggacgaaggggtagtggaggaagaggtgggaagccatcaaaggctgaatatatttcagagacccagcaggcaggctcgctagtgaattagaggtggaggatttaaaaagacggagacagtcagggaaggcccttgggtttgggacaggagccagtggtagaagggaggtggttatttgctcagccagggacaatggccggggagggctgcgtgaagctgaggagttctgtttcagacacattgagtttgagatgcctttgagacgttcaagtggaaagattgagggggcagctggaaatatgagtcgggaaggcagagagaggtcccagactagagatataaatttgggagttgtcgtggattgatggtgttgcaagtcgtgaggcagatgagatcactcgagagtgtgtggcgcttgagagggtcaggagcctgaatgtgagtcacggggcacccagccgtttaggggagtgagtggataaggggtctgcagaggagctggagaaggtgcagccagggaggggaacagaaagcaggctctgagtggacaagcaagactctgctgggcagtgcatggaaaggactctgtatgctgcagtgggaacagcctacacaaaggctcagaggcctcaataaaccagccatatttggagaggactaatggagagacaggagagaccacaccgccttcctgcccacacttggccacacaggggctaggggctgtgggcaagcgcatgcctgggccctccccgtcaccctggccggcactccctgaccctggccaagcatcttgccctgatgtctgtccactttcccactttcttcagctagcactatggacctccctcctgctttctggggctcctcccccttgtccaaaaacgcagggctccaggtggcaggtcacatgctgcccatggggaagaggcaccgagcagctccctattgagcacctgagcatggtgtggatcctttatcctaaaagatgtgaaccttcccaggccgcgagtgagtgtcagagcacctgctcccagttaggggagctctctgcctttggtgggcaatcatatacgtgcgtgtcagtgttgtgtcacttcattctttctccatctctgtctctctctttctcagcctctactgcaaacatcagcagtgccccctccaggccaggccccgggctgggtaggatcccgaggaacaagtgtgctcctgaccttccaggagctccccaccgctccatctctcccttggctcctgagtgtacctttttggtgctcaggagcctgagcctgacttagaattccagctttgccacccaccagtagtatgtcttggggtgctgcagctgccctgtactgcagttcacaggagagggctccccgagactctggaaacagacccaggagcttctgagctatccctctgctctggctgaggtttgaccccgggcccactcacccctctctccacagcagagttgtgggtcttgtcagatgctcttccccttcagcgtgcagctctagtcccaccttctccagaaagcctcccttgaccactctgaggtcaaccagtgtttcctaagcacctgtgttgtgccaaatgcagggctcgagtcagggtgtgcagagatgacagtggagggtttctgcgctgagaactggcagtccagatggggtggtggggggacaggtaaagaacccacaccttccagcataacagtgagcactgcaggtgcccagcagagagaacggccttgacttggtcaggaacggctgcacacagtatagctgccctgaacaaggccagaggccgggcaggtgtgcaaggtgtgataggggctggggggtgggggtggagagaagagtgtgtccaggcgaaggagactcgggagcacagtccagcccgtctgcagagtgagtgcggtctgacatggccaggacgtgagaggaggctcaggagacttttccaggctgagaattgaatggagccaggcagggacttgtggacctcctctccctcgggaaagtcagggggagatgcccctccaactctgcatcggggactagggcagcagcagcagctgctctgatgatgcatggctccgtggcagagcggtggcaggaggcttcgggtaatctcattagtgtgcccggcggaggggacgagtaatcccgtgcctttagactcacttttctttaagcctgtccctatccattctctccctaaatccttgtactgctttggtgacatcaggcgggactggactggacttacctccattgaactgatgggtaaaacagggttagagaggaaaattcttgcatgatgccatagctcacaaggggcaggaactgcatccgtctgactccagaacccatgctcttataatcctctactatctcccagactgtcttagactatccaggcttatagactgcctccccactggccccattttgcaggtgaggaaaccgaggcccagagaaggtaagacacttgcctagggccacgcagcaagtcaaggacagcactggcaccagaagctcacctggcctgtttgtgtccccaccccaccccacaagcaggcacagggatccccctggtccctgcccatttctgcctggagcacccactgtgcttggtcttcctgcagtctttggcaccggctccggtggaaggcaccaagttcctcatcagaaggctccattgtgcctattgtttaaatatagattactaatgaaatgccttttcattgccttcccagtgaatagtttccgtgtaaagttaatttgcagtgttatgtaaattctgtttaacttcaatcaagtttctaattatgtttttaccgcagtaattcccatttgatttgtcatctcctgttaggtattcaatgttcggtgggcgggcttgctttccgtctgcctctcagttttccaaggccctgacctcctctctgctgtgtgtctgtctccgtggctcctggcttcttcatccccttcggcttcttggtggctcatttcccacctcctcgccatccctccatctatctcctgccctccaccttccttctttcttcctcttgcccagctgcaccttcttccccttctgttttcttcttctctgtctcccctcctccctccttcctgccctctttccccctccccctctgtctgtgtcttccttctctgtatcttctttctgtatcttcctttcttctctctattccgctcatggccttgcctctcactcttcctccctttctgtgtctttctccactgacaagactctctcctgcctcctctgctcacatttccatcccagtgctcttcctctcctgaggtcttctctccctcctcctccacagtagagcctttcccgaagctgcattccggagtgcccgcgcgacagagcctgcgaggtgtgctgggctgggggctggggccaccagaggagccctgtgcagccctgagttgttggggtgggggattggtgaagaacacagagtctagggttggggtctccgggttcaaatcccaccccaccccttgttaactgtgtgaccttccggttagttcacattgatttctgtgctgcatccataaaatggggtgataattttacctgcctccacagtaaagcccttcccgaggcttcattctgcagccctgagacagtggggtgggggattggtgaagaacacagagtcatggagttattgtgagaagtcagtgagataacctatgtgaagggctttagcggagggaggggcttggccagaattagcctttttactttcttaagagacaaggtcttgctttgtcacccagggtggagtgcagtggctcactgcagccttgacctcccaggctcaactgaccctcccacctcagccttctgaatacctgggactatagatgcattccagcatgcctggctaatttttaaaatttttattagagacaaggtctcactatgttgcccaggctggtctcaaactcctgggctcaagcagtcctcccatcccagcctctcaatgtgctgggattatagatgtgagctgccacacccagcccaggaattagcttttatttgggaactcttggccatgcctttcattttttgcggccttcctgagatgcatctgcagtgagtttctggagtcctgggggtcaggcctgaggccagggaagggtgggagctggctgcagacccccatagagctggcatttcccgctccccactctccacccctcagccttcctcccctagagcagggtctccgctctgcctgtcaagagatgtggcgtccttctgtcttagtgggcccatctcaggctgtgaggacaagcctgccaccctggggtagtagcggagacacagatccccaatgctggaaaagtgctcaagactctggcccgcagacctttcccaagcaacagaccaaaggcagagccgctcctgctgagttggactagacacccccttcttctaccctccctcaccccctagatgccccaaaggctataatataccatggactccagctacaaaaccactggtccaggtgcagcatgttggcagctctgccatttatcacagggacttctctctgagccttggctcccctcctgtgtggccccaacgttgggctttgggattctccctgagtttggggattgtccctgtagtcagggaacggctgggtggccacagtttcccagcagacatctgccctctgggtggggagggcggaaggaaaacaccagacacaggcagggctggggctgggcgggtgctctgccccctccctctgctcccgcttccgccccgactctgctgggcttcccacccagcaaacccctggcacatccaggaagcagaaaacaagtgcttggggagggcattcttctgggtgaagaagggcagccggtcacttgtccttcagagacacagaagcctgggccacatgactacctgacccacaagtggctgtgcgtgtgtgtagtgtacgtgtgtgtgtgtgtgtgtgtgtgtgtatatccctgtccctggccaaggaaaccttagccatcacgtggctggtttctctcgctatttgtccaagtaagcagttcaggccagctgcagccaggaggccgtgacacagagccagggagaagggccacattggtgtgggtggtggcagcgaggatcgccatgggcatcagggagccccgagctgggtcctagagctcttgggcctcagaatctggtatggggaggcctgggctggggaatggccttgttctgatcctctgccctccctggacgactgacctccctgccccaacccatctgtcaagaaaaggcacagagcttgataacagagaactctctcagccctaaatagagagggtgggcaccttctgaccagggggagccgagaaagacagagtcctcaccagagaaaggggcacacatgggcacaaccaccatgtgtatggcccctggagtgtgctttagagccctggcctccgtggcaggagtgtggaagccaggcctcccgtgtgcatccatcaggccactgaattattagcacctactgtgtgccaggacctgggctaggcagggataggggttgtcagaacacagaccttctggaaacttcgtcaaaccctcgcctctgtgacatattttcttcccattggatgggcagcatcacctttcattgcaaaacccctgtgatcttgtcatgagctggccatttcccaccccactgccattccaggaggatgcaacccctacattgttgcagggctcaggaagagcagtgagaggcaccgccgagcctctcatggaccaagcaggtgtttctagccagggagagtgtccccttcctctagggaggtgtgagccagaccctgggcttccaaagcaaatgtgtgcatgtgggcagaacacagaggccctgggctcggacacctgggggccttctcctagcccacatggggagcagagcaccaggggaagtggcagctgcagagtggggcctccccaggccttcatcgaggtttgtcagcctgcatactgtgtcttgcatagatgacaccatctctgggggcctggaggaggagggctgtggtggctttttggggccatgcttctgagagcccacctgcattcatgtgtctgtttgtccacctcctccctgcttcttccctctttccttcctttgacaaacatttcctggcagccaagtctgtatggggcccacgctccacaaaagatacatccctcaccctgcatgatcacggccgaactggaatccagcaacattccagggtgggcccagggccaggcccaggtaaggcctaggagagagctggctcttggctaggaggcagggcatggctgaccccacaggctcccctgggttctgaggaagcttaggcgtacttccccaggataggccaacggcagagcccaccaggtgcctgagacaagggggtgtagagagccagcatcaaggccacacagagcatcatcagaccttgtctctgttgtgatgaggtctagggtattcaatctggaagagtcccacaggctcgtgtgctcaggctgttctaggaaacgcctgtccggaaaaggggtggagctgggtggccagggctgagggtgacgcagatccgccatcatgccacctacaactgaatgtggattctgggccggggtttttaataaagctgctgggtcagcatcccagaatgctgcctaggcctgtatgtccccagcctcagcttgcatatctctggggtcacgaggcttactactgccgtcttgtagttcctcctgggacatggggtcctggcctcccaccaggctgacgctgacttctgtcttccaccctgcttgtcttagggccacagactttaggcccttggcagtttccaattgagtccctcccgggctttcctccctgcaggcagagcatcaagctgggtctgtacgtggccccgccagggcctgtttgattggggtaatctggacaagtcatcagtggcctgcgctggcagccagggtgtggctaaagtcagttcctgcctaagctgggctgacccaccttctcaccactcaggagctcccggagccaggagggactgctgtgagtttgccttcatgaggaggcccttgggctgcctttggtacaggcaggagacctggatccctgctctgtccctatctctgtccctgtccctggggtaatctcgagcaaggctgggccccaggcaggcccacaccccctcccatctgtgttcatccccagcactaagccaagaggcttttgtccctggtgggctgtcggccagctggaagagtcctccttgctctctggcctatttgctttctgagtccctctgccctgggagagcatgaatgggcaggagaggggactggagagggctgagggcctctgttcagatctctgccctcactgggtcgggctgccaacctctgcactcccaccatacccccaacctgtggacaggtgagcctccagttcctgaggccacagggaatgggctggattcacctggaggccatgggtagccttgcagcccctgggccaagctcccctcccacccagactcctccagacacttcaggggttcaggcatgccaagtcagggtggggtgaaggggtctttctctaggcgctgtgcctgtggttgacatcacgttgtcctcatgtggggctgcgtggccccgtggggtggcacgccttctgcaagagctcgccctccaggaagttctgcattcgaagcctgaacttggccttggttcactcttcctctcatcctggtctcttgggcatgacttctcccaggggacactgctgtctgctgacttggaaaggcagggattcaatcaggggcccccgctcagctgtgtctgaagtgtgccctcctgggaagaaaacccagcagcacttttgtcgaggcctcacactggaaaatgaacggtgggaggcctagaggtaagaggccaaaggccactaagcaggccagcgtggcctgcccactccagcccccagaaagcattggtgcttctgaggaggcttgctcggccctccctctcccctgggctgggtggggccagtgggacaggaagccagggcggggctggaggatggggctcagggtggcctgggcctgagccagggatgaggcgaaacccaaccctggcctggccccgggccgcagccgtgcaggtcactaggcctcggcgagtggccacccgcccacccaacaggaagccctgcccagacaccacctttgccccaccccgtattctctacggctggcacttctcctatttcccatgagagctgctgccaggaatcctgccctcttgagaaaggaagcccgacctcgggccgccctgcctctggcctgcgctgaccccctccctgggcctccccgtggtggcagctctgggcccacgcccgtcctgcaccccccacacatgctaatgacttatctcctctcagacaaagcctgtgacccttggggacctagcaggagaaacctcacagtgggactaggcctgggagccaggaggctggggctcttggtctgggatcctccaccaacctgctggtgcacctgggcaagtcactcagccactctgggtctcatctgtagaaaaacagggagaggcagacgctctgcccagcaatgagcatcccatgggataaagggtttggggtgggttgaatgtgtgccctgtgaagacagccaggcttggggggtgataacacaaaacctccccatccacccctgtctgcctggaaaggagccccttctctcatctcccagaagccgggcgacggagcatgcctccgtctctcagctctgctcagggagctgggccagaagcagggatggggctgtgctgaggggcaggctgtcccaccaccctcccaaccccatcctcttcctccctcctggtgggtgctctctgacccatgacccacctccccaagtaagcccaagcccacctcagtatcagcaggggtagcagcttagggaatcaactgtgtcttaaagggggccaagcagaggggtcagggcaccacggggaaagaccagagtcgttgtgacattggatgggttaagacagatccgggggccaccttgagctcctgggcgagctgaaagcttgtcagcagcagggaagaccaggcacctgagcagccaagcccctgccatggggtggccacagctcagactctggtggccttggacacattgctgctctgagcctcagtgtctgcatctggcaagtggacctttcagagccagtgtcttagggtgctgtgagaagtccttaagatttggggacacagtgctgggccccctgcggcccttccctttgaatcagccttttccctgtgagggaaacattacaggtcaggattaggactagatttcgtaggcagtggggagccactgaaagttcttagaggagtagtgagttcatggggagaggaaccggcagcagagaagcctggcacactcatccggtgttggagccctgattcaagaggggtcatggggcaaagaaagttagcccaagtgggtgtcagcaccagctgggcttgggaggcctcagttttcctcctgtagctgggtgcctgtccgcaaggctggagaggcgctgctcagagccagcactgagggtggcaccaccacccctccttcttcctctggtgcccctgagtcccaccggcgtggggttgtctgggtttgccactcaggcccgggtgggccccactgcctctccctccctccatggctttctagctctgaatgggagtggactctggaggctgcagtgggctgcgggatgtgagccagggtgggggcattggcggtgggtggagtcacgggctgggtggccatgagtcaggaattgctgggcctgtgtgtcatctggctgcgtgctgtgctggctcctcccgcctgtctgcctcatctcgcccgccgccatctgggccccctgggctgctccaccaggtgatggtgctctgctctgtttataagagttcaaaacgtaggatggagtagtcaggggaccgggctctagggcccaggctcccccaacaccagaggtgaccttgggcaggtccccttcctcttctctgagccaatttcccccattgaagagtggatattaggctggccaagggatttcagccatggccccagatgagatccgaggcagctttgaaagatagcccagcccagtacagtggctcacacctgtaatcccagcactttgggaggctgaggcaagaggagcacttgagctcaggagtttgagaccagcctgggcaacatggcaaaaccctgtctctacaaaaaatataaaaaattagctgggtgtggtggtgggcgcttgcagtcccagctacttggagggttgaggtgggaggatcgcttgagcccaggaggtcgaagctacagtgatcagagattacaccactgcactccagcctgagttacaaagtgagactctgtctcaaaaaaagaaaagaaagaaaaaagataacccaccccaaacaagttaaatcagatctccggggcggggcctgcggccaggcttgaaagctctagtctggatggcctcagacgggctgctttctccgccctgcccggatccccaggcagcactgtgggctggtgcatgggttctggagcccagaggctgtgctgagtacagctctaccactttctaatactgggcaagtgaattcatgcctctgagcctctgtttcctcatctgtgagatggggctaacaccacccaccttatagaatctgtaccagtgtcagccaccatgttctttgatctaagccagttatgcaccactgctgccttcactgcccattcattcttccagaaaatattcggggattcctggacctgccagcctggtactgggtgctgtggcaacaggaagaggaaacccaccatgggggtccagccttttaggcctttccagggccccagaggatgggttctgtctgttgatgggcaggtgaagggtgactcccctgagaatctcaccgtgtcgctggactgagggaacccctctttctgaaagaacgaatgagaccccagattcaagggagaagaaggggcatcctaggacttccctgacagcctcagctgggaagcccctggggaggctctgaatgccttctggggtgggccctgggccatgctctgggcagatgctggctcaaacagggctggcagtagacagaacagaataaggaccctcctccttgtagtccatcactgggctggactatgtcctccatcccgtggtcctcctggcagcccagggcattggcaggcatcgttcctcctgcttggcagatagagagacagagatgtcaagggatgggaggcacttgcctaggtcaagggctggatttgaacctcacttctgtataaacaaaatcccagtggggaaagtcgagcttccctgggaatctgccctggtgggactaaaacgtgatcggcaaacctgtcatcccctttcttccctggccttccagcaggtcccctgcagaccaccactggctgtccttgcgggagagacctgatgttcctgtaaatagcaagtgctcctgttgcctgggctctgaaagccagaggttgaaccatgcacttgtcacccactaaaccttctccctcctcatgacccattggagaaactgaggcagagagaggtgcagggacttggctaaggccatgtggcttgtgagccggccaggatttcatccaggcctgggtgaggttagagcctgtgcccagacccgccaccacccgctagcaagaacaggactttcctttgtccggcatttttaactctgggtcttggccatcacttcagactggcctggcccacgtgtggccagaatcccaaagggatgcctgtttgggaagcgtgaccgccagggggctggcacctggcccaggaagggggtcatcgagaacactcagtgctcagtggtttgtgtgtgccaccgacagtgcccgtgcccttcagcgccacgaccttcctgtgccaatcatgggtatgatgtcagttcatctaatccttgagctgcagttagccccagatgaggaaacagactggagggataagtgactttcttgtgggccaatattggaccccctgggtcctcagttggacctccaacaccagaatggacctgggttccattctggtccacaaaccccctttgggtttgtgtccccttctctgtagggtggcaggcttgcactcagagcttcccaaggacctccaaggactctgctgagagcctctgccaggcccatttaatgctgcagggcatttaggattgggggcctcccagaggtgggatggggtgccctctagggcagccctcagaagcatagggccaggtggttggcaccaagcagagtgggcagaggcaagaggcaaaacttctaagagaggccaccagcaggaaattccacttagaaccctggcattgcaagtggcaagggcccaggtgggtgccgggggacctggtctggccacccccagctaggcgcccctttaagcaagacctcggtccctggaaaagggatggctgtgcccaccctatggggcctgatgagtggtgggtgtggaagggagtacctggcacggattttgcacctggaggatgcttgacaccttaggctgcttctgtggaagaggaggtgaggaccctgtcctgggagcaggtggttctacgaagcccagctgtgggggtctatgaagcctctcctgagttggtctcggactcatcttcccagagccatgggtctttctctatctctgtgatacggggttcagtgcccccatcccagcaggaccccaagtctacactgggcagcaaccctgagccagtgataataatgacttatggcccctgtttacggagcatttcctgtgcacgtgcatatgggcctaatcttgttatgtccttcaacaactctgtgagagtagtgactcttagtatcccccattttacagatgaggaaactgacccaagttcctagcccagtatcacgcagctaagtaagtgtcagagctgaggcctctctgatgcatcggaacctagatgcattggaacccagagaggccaccattctatgctgtgccctcatcccttgattaaagcagaaattgttcatttggtgacttggggagaagggagccccatccctcttcctcaggtttgagcgggccacctgtcagagttcaaggcctctttgattgcttggaggtgttggctggggcagtcgggacagctttccccctccctttcccagttccaggtctgatgcaaactcaaaggaaagggaagccagtccctgactgggcctgagtcatttgtttctgaatcctagtttgaatcctagttcccgtttttatcatggtgtgatcttggctgggcccttccctctctctggtctcagtttgtctctgttcaagtccagcaccaagggactaggttggcaggggccggaggccagacaa

SEQ ID NO: 1605 - DNA, 7588 bp, Homo sapiens
ttttcactgtctgtggacattaaaaaagcgagcggcggcggcgggcgccggggagagcgggcggccgggcggcaggcgggcgagcagcgatcgggcggccgagcgagcgagcaacgccggcgcagcgcggtgaccccagccccagccggcgcggagcaggagccggagccgagcggatctcggcgccctcgctgcgctcctcccggcccgagcctgccctacccggcggtggcggcggcgcgtcctccatcggcggcagcggcgctcgcagcgcccgtgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtgggacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccggtctgttcctctttccagatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcagggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagccacccaccaccacccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatcagggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaggtt

SEQ ID NO: 1606 - DNA, 3222 bp, Homo sapiens
atgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccggtctgttcctctttccagatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcagggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactga

SEQ ID NO: 1607 - DNA, 27079 bp, Mus musculus
ggaaccaggcatggcaggaaagccaccctggagagcccctgccaggcggcccactgcttctcagcagcctcactgtgggtgagactctgtgggatcccacgtcctgtatgacttgcccagtttatcagcacccgggcttctgctcagtgctcagcatacgcctatttctcctgagctgtgtgtgctgatggtttccatgctggggagggtctgtgaggaggtcctgtgaagaggggaccgggagctgagggattctaggcaggggctctaccactgagccacgcccccagcccctcactgggggattctaggcaggggctctaccactgagccacgcccccagcccctcattgggggggttataggcaggggctctaccactgagccacgcccccagcccctcactgggggattctaggcaggtgctctaccacagtgctacagccccaacacatttctgctcaattgtgataaccaaatctgtgtgttggcattcattgtcagatgtctaggacccaaatcaccttgaatgaaacccaccgggcaataggctgggccctgcagacagcaaggaataaggtagccctggctacggagtgggaggagcttcagaagatcacctcccttccatgttagcctcggctggtctctgtcaccctgcggcctcctgtttcctgttttggtgaatccctgagccacctggcaatgccaactccaacagtgcctacacctcctgcaagactaaactcttcctttgattaatccctcctaaggaagcaaggaaagacaacaaaagctggtctaggcagtttcccagcccttacagctttctccatcttaaggctccaaggacacagacctagaggctcaggtgagcacactgactaacaaggacttgccatatcccgcatttacttcatctgctgtgccttccctgggctcgcaagcctgctgtggctctgtcctctcctcccaggtggcatcacggccctggactttaggctccagctcatcctggtttctattgcattgggtgctaccttcacccatgtctaagcatacaacctctccagacaggacaggacccctctgcctgccccaagtgtctagtccctatgatgggtcaacaagatgattcaacaggttaaagtgcttgctgccaagcttaaagacctgagtttgatcgctgggaccaccatggcgggaggaaaagccaactcctgcaagttgtcctctgatctccacatacatacatggcatgcacatacatgtatacaagtaaagagatctaaaaacaacaatttttctttttaattcaccacattaagccaagaacagtgcgttcatacccatgatgaggctaacccatcactcgggaaatctgaggcaaaaggattgcttcgaattttaggctagcctagggtacatctggagacctgatatctgagttaagttaataggagcgaatgagttggcatggacaaagtacctgctgtgaaagcataagagctttaacccggacccctagccaggtcccgtggcatgcgactcacctgcaatcctgaggctggggagggcgtacaggtgggtccctggagctcacagatcagccgctgcagcccaaccggtaagctctaggtttagtgagagaccctgcctcaaaaagtaaggggctgagggatagagaaagatacctgatatagatgactgtcctctacacatgaattcacagatgatctctctctctctctctctctctctctctctctcgctcgctcgcacgcgccacgcgcgcttgtaagggactgtgatggacgaatgggtgaagcagaagggagcatgggtgaggcagacaggaaagtgagaagtaagcagagcccatcactgactctctgacgctgtgctgatagcttgtctctttggaggtgtgcttgtcattctggtacagagccccccaccccccagccctttccacaccagcctggatgatctcagatgccatttctatttcatccttaggaaggtgaagaaagctggcctcatggtaaagacctgacatcccagttactcgagggatggaggcaggaggattgccagttcgggaaacagtgagattctgtctcaaaataaaagtcataagagggctggtgagatggctcagtgggtaagagcacccgactgctcttccgaaggtccgaagttcaaatcccagcaaccacatggtggctcacaaccatccgtaacaagatctgacgccctcttctggagtgtctgaagacagctacagtgtacttacatataataaataaataaataaatctttaaaaaaaaaaaagtcataagagagctggaagtatggctcagtggtagagcccctgcctagaatcccccagggaggggctgggggtgtggctcagtggtagaatatctacttagcatattgagggtttaaattcaactcctattatttagtactactaagtaatatacaaataaaacaaagaaggagaagcatcagatcacgttcctgaggaagagcttacagggagagactccatcattcagtaagcagagtcctatttgagactctgactatccaggccagagcctcctcccactgtctctgggatcctattccaccgccttggcatggggtcacgaccaggaggctccagaaccactgggctcacccctgcctgcctgctgcaactgcacaagctagccattcttgaagaaacaaaggctggctgggttgtggtggctctggcgtctccctggagggtgtctggcctctgcaggatgttggggagtggatctgggtggtggttgaactctgtcactgggtatcgcaaatcacattaagccagcccttcacccctccatgcagtccagctgccctctatggtcatagggctttcagtcagctgcttaggcagggatgcttttggctcccgggcagttgagttctccccatgctgtgcagacccttgaactcctgtgcaatacctgtgatactgctccctgcgaagagttcgtgaaacctagtattggtccccaacttcctccttgagatttgtgtcctgggccagctcagaagtcagtaggtgtccctgacacaccttcttattcccaagaccttgtccttggaggacaaggggcagcagactgagtccttaccccttcgcatgtgtgcatgtgtgcatgtgttcatgtgtgctctgccccctgacacctgatacctaaccattactcctacagtagacaccaggctctgctttaggcatgggctcagccttgatggtttctgctctcatagcactgacatgtggcaccttcacagatatccatatatcctttctagtgtctagccatccactgtttgtttggttggttttggtttttcaagacagggtttctctgtgtagccctggctgttctggaactcactctgcagactaggctggccacgaactcagaaattcacttgcctctgcctctcaagtgctgggattaaaggtgtgtgccaccactgcccggcttccatctgttgtttacacatcctcttaccattcatctatctatgcatccatccatgcatctacccatctatgaaaccatccatttgacatcccatatgtccctccatcctctcacccatctaccgtactgtttacacaacctctaactcattcacccatccaagcttccttccatgcatctatccatttatccatccattcatgtatccatccatgcatccatccaacatcccatctgtccccccacccacccacatcatctacacatcctcccatgcagcagactacccatccatgcatttgtccattatccactttacctacccacccatcccatccatccacctcccacacattccattcacacacccccactccatccattccccatcacctaattgctcattcatctattcacacatccactcaccctcccacccatctagccaccccattcacgcacctacagtctgtctgtccatcctctaccccctgtgcagcatgacccttgaaccctgctttgtggcagatctggatgagaagtgaaatgttacccgcctccagggagggtgggagatgaacaggctgttcttgtttaccaagtaagtaagtaagtaaataccaagaggaggggttacaagggctgggaaaggggaaccatttagggcttatcaggataccccaaaccagagtgccccctgaagttttgcccagccacttggtcaaaggaaccagactctaacccacactggggtccaggatcaatcaagcaactgggtccatcgaactgtgcctgcaaagcgccaggacggaaggcgccagcgccgtccctattacagagtagagtgaagccctcagcctacagagagtcgggaactggcccaggaccacacagaatgtggcagtggtgaggggtactgggaggagcgggcagagcgggcagatgggtggatctgcatggggcggctgtctcttgcagctggagtctgtcgaatctgttctcgggtagtgcccaccccagttgatgggaatcagctgctgtgttaattctacccttgtattcctccatgcttttgcctctgccctccccctctccccactggagctggctgtactgaacttctagccaaccccttcccttcccccttctgccaggagtgacagaaccttctgtactgagcctcaccgggccattttgattgagccccgtctctgctgtatgtgtaccagatttaaaaaaaaaaaaaaaaaaaaaaaaaaaatcccagccctacctcattgtactgccttgcagtggctttagggatacatttatccttgggcatgtgtgtatgtgtatgcatgtgtgtatgtgtgtatgtatgtgtgtatggcacacaggtacacatgtgtgccagtagagaccaaaggtctcaacctcagattttgcttttgtttggtttggttttgttttgagacagggcctctcactggactgaatcaactcaacgggtaagcaagggtagctgccagtgagccccgggaagctgcttgtctctaactcctcagtgctacgattataagcacacacccatcatgcctggccttttatgtggcggctggacattgcacagtaaacacttttgccaactgaggctatgtcccctacttttggtttttttgaaacaggatttcatgtagctgaggctggccatgtttttctgattctcctgcctctgccttttaagtgttgggattacaggtgtgcaccaccatgcccaacctccctggcttccactgccctgctaagggagggctggttcccagactgccagctccaagaggtggtgggtgtgggctgctttggatggcttcctgctgagttaatagttcacgtatttggtctccatagatcttcccaggaccctgcatgggagggcaggcaactgtcggggcctcaagacaccaggaggagggtggtaggcagatggccagttccaacaattcccaggagactacaagactaggccagggaagaacctgtgtcctcaggacttcgtgagtttgacgtcagctggagagccctggctcattctacaggggtactcagtttcaacagtcacttgggcatctaccaaccagggactggcatagtgaatcagagtgcaaaaactacaccttgagtctgagagctggcacccttacctgctctgccacaaaatgacaggggacccaactaggtccccgatgtcagtaaaaaaggaaaagttaattttagtgacttgaaatgaaagctgtgactcaagtcacattaggggacatcaaacatacaagattcaaatcctgctcagtgagtgtgggggaaagattgtatatgggttctgattatagagagggaaatgacatggaaaataaagggaccaaggggacaggtacccagtagcgtcagaaaaacaactgtgaatgtctcaatatgtctcctggcatgacaggtaaataaagagtttctctggaatctataatatgatggtcacatcctggatagtttcttgttctctatgtctctcccctctttgttattttattttattttattttatcttatgtatctaagtacacactgtgtaggttcagatacactggatcccattacagatggttgtgagccacctgacctggaagcttctatatagaccaggctggccttgaactcacagagatctgcctgcctctgcctcccaagtgctgggattaaaggtgtacatgaccacactaggcctgatgctctctctccctttaacatcatccatggcccactagccttctctccagcttcaaggtcagtaaaatcccaggactgtaaggaaaaggaatgaaactgaggcccaagaactcacagcctcagagagggtttggcttagcagtagagcccctgcctagaatccctcagtgaggggctgggggcgtgactcagtggtagaacacctgcctagaatcccccaatgaggggctggggcgtggctcagtggtagaacacctgcctagaatctcccaatgaggggctgggggcgtggctcagtggtagagcccctgcctagaatcccccagtgaggggctgggggcgtggctcagtggtagagcccctgcctagaatcccccagggaggggctgggggcgtggctcagtggtagagcccctgcctagaatcccccagtgaggtgctgggggcatggctcagtggtagagcccctgcctagaatcccccagggaggggctgggggcgtggctcagtgggagagcccctgcctagaatcccccagtgaggggttgggggcatggctcagtttagagtgttcactgcctgcaccctagtatttcccctcccagaactttttctgaggaccctaggggcttcccgaatatcctgatcttccctctctagctcctcattttctgtcctgggatgagcgccctaccctcccatgcccagtgggtgtctgcagggagtccatgggtccagaggaagggagtaccccatgagctcagtgcaggaagcaatagggagaggcgagctggttatgtctccctctggttttcagacctcaaggaggaaccacgaaattccaatcttctgacagcgaagaaactgaatcactcttgccagagcctgcagcccccacaagaatgcggtaaggctttgacctgccgttccctgtccagccaccacagtcagagctggttggttccttactccatggccgacccggtctcccctgcatggctcctctgtggcaggcatggacactgcaccagcccctctctgggcatcaggttgctttctttacaatggggaacatgaggacttggtggtagcggcttgacatggtcccaggcttgggatgaaggcgcaccaagactgacaaccagctatgacttggtcaggtgggtatggaaggaaggcataggtagtttgtttcctctcctgccgtcagagacttgataaatgcccacgaaggtatcttccctttggtttaaatggaagccatgcagaaagttagggtgattaggggacttgagctattgggaaatgaagacattgtatgtgcggggtggggggacacggggtaggaccaccacaagacatgtggataccaggagagtcttgaattcataggtgacaacagagagtcatgctatagtctattctgtgtctgtgtttgtgtgagagagagacagagagagacagagagacagagagacagagacagagagacacagagaaagtagaatggaggctgccaagtggtccaggagaggggtctcaaggaggagccttagacctaaaacactcggaagacacatagatagtttttggtgggaatggattagcccctgaggctgaggctggaactggggtgagtttatttggagagcagtccagcagatagcaggtaggactttttccttgtccttgagggaccaggctctggcaggaggaggaggggtttatagcaggaggtgacgccatgggagctttgtcactcgggcacagccagcaccatctgcttaggcatctgcctaccagaggtggtgcctcctaattacctggggggaggggtcaggaagaagcctgggaaccaccatatcccactccctcccaccacagaggggttgcagtgtcccacagggccctcagagcaaatggaccagagatccactcctgggtggggtgggaggctggggggtggggtggggtggggagagccctggctacacatcaattcaaagtcattttattttatatttgtgatagggtctcatgtagctcaggctggactcaaactcactatttgccaaggaatatttggtgcagagatgaaccgaggcgtcatacatgctaggcaaacactttaccaactttgccagatgaggtacatttcaggcgctcttttacacggcagcaggggctgacccgatattcactctgtaactcaggctgcctttaaatgttcagcaatcgtccaagcctgctacatgggctatcatgtctgtcttcattttgaaaagaattttgttgaaagcaggtgtgcgtatgtgtatgtgcgtgcgtgcgtgcgtgtgtataaatgtgtgttgctcaggccaagttgcacgtgtggaggtcagagggcaacatattgttggttctttctgaccatgtgggtcctgggaaataaactcaaatctgcctaggtgacagttgcgtttgcccactgaaccatctggccagcccctgcagtaagtctttacctgatccagcctgatgccttcttttaacctccaagagagggacggacattaagaagagtgtagtagagaaataattagaaatgatactccggtctaaaatataaacgctagggagtcggcgacagaaggaacagcagtttatccgtggtggcagggtgggctcagacttcctttgaagggggacgcggaaactgaagccaaccagacccaggggcagccaggcggagagccgcccccagctgcgctcccggaagatgcagcaggctcgggctcggaccctgctcccactccaggggacccttggccatttccggacccgtagcctctcaccctaccattaggcgcacattcctgccgcccccgctcgtgctaggcgcaggcaaggcccccgcccgtgggaagggggccgtgtgccggggaggcgggtctgggatggcgcacagctgggtcacatctggtaggagtgcggaggaaccaaatggaacagaaggtagcctttcatccttcgaggaaagaggctgcttgagtgtctcctcgctacggggtgcctgaggtttttggggaccaaccctccccatttaggaacatgatgccaagacaggcctgcctgggggaggagggaaggatggaccgacggagggacgtagaattttgtcactgatacccttttgcctgaacttcaggtccactcctaagacataagtatcagtaagggcagctcaaaattaatcgctcaggacacactgcaggctaccactttggctcagtcagcaccgttccccagggaaggaaacccgctcggggacaggaaatgcacagcgagaagccaaggatgtcgcccgcggaggagcactggccctatcacccaggtcccagcttcgggggcgcgtcctccacgtgcagccgtggcgggcgttggtcaggctgggtgtctcccagagcagctccggagggtgactcggcgcaggcgggacaggctcgtgcacaaagggggcgggtgccgtgggtaccccagctgggtggttcccagccccttgtccgtatcccacgtgggaaggagagatctccctaaaggttacgccccaaggctagcagccaattagcgcgtggaggcgtggcgggcaggggaggtttaagagttcctgaagcgagaggcgcgcagctggaccgggagcctcgggcagccggaccagttggcactgggatagatattacgtgcggccgccggccaccatgctccagcggtgcggccggcgcctgctgctggcgctggtgggcgcgctgttggcttgtctcctggtgctcacggccgacccgccaccgactccgatgcccgctgagcgcggacggcgcgcgctgcgtagcctggcgggctcctctggaggagctccggcttcagggtccagggcggctgtggatcccggagtcctcacccgcgaggtgcatagcctctccgagtacttcagtctactcacccgcgcgcgcagagacgcggatccaccgcccggggtcgcttctcgccagggcgacggccatccgcgtccccccgccgaagttctgtcccctcgcgacgtcttcatcgccgtcaagaccaccagaaagtttcaccgcgcgcggctcgatctgctgttcgagacctggatctcgcgccacaaggagatggtgagacccagcgcggcctgggcagggggatgaagtggggatcaccctctggtccaactggtgactgacgatagcggttcccgatgcgttaattgctttgggtctatctgggaaacgatgacactgataaatcccattacagccccgtgtggctgctggggttcactttgccttactaccctggaagcttccttccgtgttgcccagggtcaccccagccacatgctctgtgtctggatgagtcgcctccagcttagggctggctctgtaacgcttctcctaaacactggagtgaatggccatatttgttcctaaactttttcgagcaaattggctcagttccatcctgggtccccttcactccccttccttcttcctgggtggaaggtacgcccccttgaaagggagggaggaaaaggcatagcacacccctggaccaggcaaagtgaaagaaatgggtgctagttctccagacttgctcagaaccctgacttcagtagctcagctcccccacctcctgttagaccaacttcatacacataataaaaagacacaccccactttgaaaatctccctggaggctacaacaggaccgttggggcgggagagcagagtgcactgcgtgtgtgtgtgtgtgtgtgtgtgtgtgtgtgtgtgtgtgtgtgtgtgtgtgtgtaggggtgggggtagatatttggtgtgaagactaagactcactttccttcctgacccagccccagtgagacttcgctttaggacagtggaggttaagaggacaggctcctatctagtcttggtcaaagaggggccctgagaaccccaccgtagcctcctgagaatgaggcgtccctttcccaggggctcagcaggccttcgggagggggcagcggggggccatgggttttgtttggctgtggtgccgttaggattcccagcgctaggctgctctcacgccggccccttgggcaaggcaacaaagcccctttctccagccgagaaaggcgtcggcctcttgtgtacagctatgcgctccatgggaaccgttggctggcgtgctggccactcaggttgcctggtgatgagggggcctctgtgtcctccccccagccctgaatgacagccctcgtggggcacgatccctgagccagggcattcccccaccccttcattcagccttcctgctgtgtgatattggatagcatctatcccactctgggccactatcggttctgagaaactcttattcagggatttgggactcagttggactgtgtggtctggtgagaagcctagggtctctctgatcctctcttgctctcagaaaagggaaatactttctagtgaggtattataaagtggactgtagaactttggaggctcttggtgatcccagcagtcattctgaataagggggccccctacccagaaaatgctgcatttactgccatgctcacctcccgtgcacatgacaggcaaagcccccctcttgtgtgctatgatcaggggctcttggaacctgtagcaaagggcctgctcccctgtctgtccagggcggctgcagtctgatggaaggtgagagaggctccattaacctggattggggatgaatggaaggaaggcttcctggaggaggaggttccatctgcatcagagtcctagggtccaggaagggcaatcttggcaccaggcatgactgtggggctgtacaaaaaaaccaagcaggctcggtgaggtggagaggctggtcaggggtacaggcagagcgcctggcctctggcccgctgctcctcccccaccactaaggagcgcgccaggctgcaggctgccaccgccacagccacaatggctggggcagaacttggcatcctgtgtttctttgaatctcggttccaggaacaatgctgcttcctgtgtgtctctcccccacccccttgcttgccctcaccagctctgctgcccccctctgccctgtccgtcctccttaggggaagttggtgggatggggacagactgagatcagggtctcccattacttcttcctgagtgtggccacaggccagtgtcctctctggtctcttaactatatgccaaggagaaaagaagatggtactcacttcccagggacacttgggagaggagagtccatccctagcacttggctgtgcacaggcaagctgtgttgtgcccattttacagagtttccggtggactgagtgatacccacaggtacccctgcccccctcctctcctgtggagatacaccaggcagaatacccacacaccccacactcagcctctcaaagactgttctctgggcctccccccccccccaccccccaactgaacaaaggtgactttaatctccgtagccttgggctgggtttttaggacaccatcgaagcgcgggagaacaggcctctctcttgatctcattaagaaagcattttccttttaatccagcagcagcgtctgcacaagccggccctctgtacctcccacggcattcctgggctgagatgctagggtgcgggggggggggggtgtgctggatgcaagcgagtctgtgcgtgtgggctgccccgggtgtctgcagagacctggaaggagggggtgcatacttgcagatgatatagatcccacatttcatctcctaacctgggcttcactggagtgagcatctgggtatgggatcagcctgggtaaaggagtaaggctgctcgaggcatggtgtgccacccttgtagacctggggtttcttgggtggctggctgggtacatgctgacctccgtgtttgcatgctcacacccaggtttccttgggacccttttgtgcacaaaagcagagggaaggctggtggatgttggggagcctgctgcctctgctgtgagcagcccccaaccgccctagggttgcactctgcaatgccagggtgcggcagtcggcacgcgctgggcgggccggcggaggaaggaacattccttcccgtgtgccgacgggcccaggcgggcgccggcagctcctggccccgccccggcgcccccctcctcttccgcagtgcaatcctggcagggggtggcccagcgctgggccaggtggagtcttggctgtggccctgggcaaagccttctgtaagcggggaacagttttcctctctgaagcctcacccggctgctcagataccccagtgggcctggagacatgaatccttttctgctactaccatgttgaccgccgtgacctcccagaacctgactgggtgctatggctggggaaacctcttctatggggcacaggaggaagtccaggccagagtcgcgagcgaccaatggccttaccccatactcccgcgcacaggacctcttgcccagccggcccagttaaccaggccagctgtatggaaatgacagcccggccactcctgcttaactcggcagagttaaggctggcccagcccaggacaaagctggcggacaatggctggtgattcatcctcccttcgggtccctttgtctgccagggcttggcagcggcccagcagaggcctttgtccccgacccgagtgagtgaggctcagcttcccaaagccgacctcctcctcctgtcccccgccccctcccacagcttggaaagcctgcaggctgggcgggctggcaggctgtgtcaataagggtgtgtgccccgccaggtgcacaggttggcggagggttagttgaagcccgtttacctggctggtggggggggcatcccacctggctcgtgcctcccagctgcctgtggtgaccttgggcccacctgtctgaagttggagagtgagcccacctcccccagccagccagcccgccagtccagctgccactccccctgggcacttgagcacacattctgtgtgcagtggagaattcaggcagttcagtgcagggtgggggaggagtctagattgggtgccttggctgtggtcctcgtagggcactttggagctggaaggctcaagatcctgtctcttcttccagacgttcatcttcactgatggggaggacgaagctctggccaagctcacaggttggtcccaggcttgggggtggggatgagggtgggaggcgctggtcccaagcaacttcttcccccgaggctgtgaggtcactggctgccgcctcggggctaagaggccagttcactcggcttgtttgcttcatgccccgccccaccactccccgggccccgattcttatgcagaggagaccctttcagtcctctggggaccctttgagtcccgcttagcagcaacaggtggcgggtactgggggaaaaaaaactggctgaatgaatgggcagcggtggctaccctggggagggggctaggctgggcagggctggggctaaggttcgaagcaatgagaaatgcctgccgcttgtgcggaccaggcctgcttacgggccctccccgtccacaggcaatgtggtgctcaccaactgctcctcggcccacagccgccaggctctgtcctgcaagatggctgtggagtatgaccgattcattgagtctgggaagaagtgagttcctacctttccctctgtgccccatccgtgccccttccctggcagcccggcagccctcgacccctgtctgcagcccctgacagcatccctcccgccttgtgttcaggtggttctgccacgtggatgatgacaactacgtcaacctccgggcgctgctgcggctcctggccagctatccccacacccaagacgtgtacatcggcaagcccagcctggacaggcccatccaggccacagaacggatcagcgagcacaaagtggtgagtgtctcccagggtagcacacaccctgaggtgttagggaggggctgagccacctttgcaaccaggagtctcctgacagcccttgtttcacttcacccagagacctgtccacttttggtttgccaccggaggagctggcttctgcatcagccgagggctggccctaaagatgggcccatgggccaggtgagtgtcccctgcctagttgccactacccctgacagcagactgttcctggtgctcgctcttggtcctgggttccctgcagcagcagcgtctggcttgggctattctctccctgccttaggtagctgtgttttctgccactctctctacctctgataaagtcttcggcatggaaggactctggctcatggcggggcggggcatagtggactccctctttttggggccagtttggcaaagtcttgtctactcatggcccagctactggcttcagcctctacttactcttccccgggcccttcccttgcagtggaggacacttcatgagcacggcagagcgcatccggctccccgatgactgcaccattggctacattgtagaggctctgctgggtgtacccctcatccggagcggcctcttccactcccacctagagaacctgcagcaggtgcccaccaccgagcttcatgagcaggtgcgcatgtggcccccaggcctgggtgaccaagcagagaactcaacagttgagggacagaagggagagggtgcctccaaggaagggacaatttttatctatttatttattgattgattgattttggttttctgagacagggtttctctgtgtagctctggttgtccagaactacctttgtagaccaggctggcctcgaactcagggatcaacctgcctctgcctctgagagctggattataggcatactgatacagggcttcactatgtagcccaggctagccttgatcctcttgctgtagccccccatatgctaggaatcagctgtgtgtcaccacacctgattcagagtcgtttaggggtggggtgtatgtatgttttcatttatttatttttttatttacttagagatgggtctcttatagcccaggctagccctgaagttgatatgtagttgagaatgaccttgaattcctgatcctcctgactccactttcctgggctagggttgtaggagtgtactaccacatccagtttatgcagttagttgggctagcccagggtcactgttttaaatagggatatcagagactcctcattctcaggtgtcacagcctgctggtccacatgaggtaccccagtttcactctctagctcctccaaaacagaaagtcaaatagattcttctaagttgctgatcatgccctttgaggggacactcttgctctgtctcccttatggtcgtaggccccaccatgggcttcatccccaggtgggccgagccagtgtccttggctcaagggacagcagcaggaatagccaggcaggactgccacctctccagcatcatcctgttgctcccaatgcaggtgaccctgagctatggcatgtttgagaacaagcggaacgcagtgcacatcaagggaccattctctgtggaagctgacccatccaggtaagaactcgtagagggtcaccaagtacccccggggttgggggggtggcaggaaccccatggttgggactgccagagggcccatggcacccccagcccacgcagaccagtctttactctgtcccaacaggttccgctctgtccattgccacctgtacccagacacaccctggtgtcctcgctccgccatcttctagcagtcgtggttgaaactctgtccctgggcgcccctggtatccaaagggcccagggacctttattgtatgccctggccttggtgtccgaggctcttcagggctatgtgtatgtgtgtgtatgtctatatttgtgtgtttgtgtggcgtgcccacccgtgttgcagactgctgggcagtcgtgttcttcagggagtggcaggtctgtccctaactacactctgagcaccactccgagggcagttgtgtgggatctgtgtttggatctctgcagtgggggtgggtgaggccttggggctccactcaggggtccgtgggtgctgattgtagcagtctcttatgttggggtgctagcacctatctggagccttccctgtcagctgagctgtgcccagtcctagggaagctgatttgggtagtaaaggcctggaccccttgtgagctctggcccgggcgctgcctggtgccattctggtgaacaatgctcccccaccccctgccctccagggtggaggcgaagtcttcagccccaccctctgatgccctatctttgtctcccacaccaagtggggttcagagctatgaattttatctcctctccaaagtagagagaaagtcgcccatagtgggtgtgcctgtacatattgtgacagtatttttttactgtgctctttcttgaaagggtcacccccaccacccccaactcctcactcccctacccctgggctgtattctgtgttctttttgcaaagaccttaactaggcaagctaatgatgataagggaaaagctctcagggaattgatgtgttgttgctatggtgacgtccttcctctgaataaaggtgctctttgcagcaacccaaggggccctagtcttgcttgggagttggggctaagccacctgtccatcaaggtaactcgaggggactttcagatgagggcaggggagacccagtcatgacatagagaagaaggcaattggtaagaattcagcaagttagccgggcatggtggcgcacgcctttaatcccagcactcgggaggcagaggcagggggatttctgagttcgaggccagcctggtttacagagtgagttccaggacagccaggactatatagagaaaccctgtctcgaaaaaccaaaaaaaaaaaaaaaaaaaaaaaaaaaaaaaaaaaaaaaaaaaaaaagaagaagaattcaacaagtttacgacttgggagggaaactagtgttaaaatagatgaagtatggccagcttggtgtagatgtgcctctgatgggttgataccatgttgggaggtgggaattggacagggctgatggcggtagctgcttgatcaggtcatgccctgtgtcaacctcactgtgtccagacctttctggaggaggtgcagtggctagtgggggctggccagagacccattttccagacaggaaaactgaggctcaaagcaggctaaatgaggatgaccaaagtcaggcagccaggctgctgaggtggatgacccccaccccccctagatcttcgttccctgtcaactctgctgacactgcctggcctctcatctgtcatgagatacacctgtcatgtatcctctgaggatgggcagtacccaggctgctcactcgtgggtagagctggcgaggactcggatctttctgaggctcttcagggaccttcctcaaatccagccacagaggctggctgatcgggggatcctcaccacactccttccctgtggtctccttgtttccgctcctttacagagaagcaggctagtgctgcccacctgctgcccttctgtaggtggctgcctgctctgacctgaccccggactcacggggctaggtcctcattacctgccacccctgtgtcctttgccttcttccccacaccatttgattagagatctgtcctgcactccaccagacattgctcacagctgtgggttcagcacccccaagtgggctgggcatggcccttgctggtaactgctcttgccttgtggggtgactggccagagcctgaccccaccttggctttgtagtttggctttttaaggcctgaggcagctgcctgggattttcagagtaggggatccccagtggtggccgtggtccttggcatacagggcctggtggcggtggcttggggccctacttctagatgaggaagctgacatttgtaagggtggaaaggtcacggtggagcagtctgcacacgggccatgagcctccttcctgcctggatgagtcagaggcctgctaccctctgctctggtcgtcaaaagccccttgcagctggcacagagctggcagccacagaggtgtggtacagcggcaccaacctcgccgccggcatggagctgggggccccagccagggtgagcttcccattctgattggagccagagggtggtcctgagcctggagggcagaacctcagcacggagcaggaggggaacccagtgaggtggcataggtctctaacctagtattattcatgaggctgttgaggtaggaggattgtgagggtcgtgagatcagagccagcatgggttaccaagtgaggtcaaaaaaatcatctaagaaacagaagccaagtagggagggcccaggaagggtctagccagtggcttcaacaactcccaggtagagcaggcggaagagtttctcctgaggagggaagcaagctgactgactgactgactgactgactgactgactgactgattgattaattgattttttttcaagacagaatttctctgtgtaggcctgcctggctgtcctggttgatctggaactcagattcacctgcctctgcctcccaagtgccgggattaaaggcgtgcgccaccaatgactggctgcctggccgcctcagtgagggtcttagcgaggagccctcctctctggtcagttactcagtcaggtatcctgtcctggggcttccaaaagtttataaaacgccaggtacactgatgcctcgtgcctgtaaatctcagggatggggaggcagaggcaggaggatcgccaagagttcaaggccagcctaggctacctactgaatgatgctcctcccctcccagctctcaataaaagtaacactgcacaccacgcaagctctagggtgtcagggagggtgcagaagcaggaaggcacccagcttcctctctcgagatgagctgggtctgggagagggtggcagggtagggttgaagctttcaacttccctctctgaacttccctcccctctggggtcagcagggctgacttcctggaagaggtgcctcactgctggagccggaaggccaaaaccacagcgtgtgagcagaagtcagcatgtgtttgtgggtgttcaagcttggcacagcccagacaaatgcaccccagggtggggtttggagggacctggtgaggagaaggctgggaagggcagtgagcaaagccatttcgtctctccctgaggctggacctctgatggtagaagtcagagcccgctgggtggcttcagcctctgttctgggcctcatgaggtctcaagaggaagcagaaggccctgggcagacagcaatttgtcagacccattggcctagcctgtggcacattctcctagggccacctgaccccagccttgacctctcccccaccaaaacaacaaaaaaaatttatcttttcctattcatgctcggcatttaatgtttttaaatttttttttttaagttggggctggagagatggttccatgattgttgctcttgcacagcaaggacccaggttcgattcccagcacccacagggctgcccataactgtctccaatcctaggggatgtaacaccatcctctggcctctacagacaccaagcgtgaatggtgtacatacagacaaacgcctatgcatgtaacttataaaaaaaggttaaaaatattgggggttggcatttgtaaacattttttaaaaagatatataagtacactgtacctgacttcagacacaccagaagagggcgtcagatctcattacaggtggttgtgagccaccatgtggttgctgggagttaaactcaggacctctggaagagcagtcagtgctcttaacctctgagccatctctccaaccttgagaaatggtttttgtgtgtcatgtgcaagttaggtcactagacttaacaatacgtaccttagccatctgcgtcatctcagtggtcttttggcaatttttttttattggtgtatttccactgtacacagtaatttcattaagatagctccatttgtcacatgctttgacctattcatcccctctacctctgtcccctctaggatagtcgtctttctgagatagcccacgtgtactttcatatcacacacatacacacacacacacacacacacacacacacacatccatgagaaccgacaatatggctcagtcagtagagtgcttactaagcatgaaccaagtcctgggttcaaatgagtatcacatgaacatctttggatacatagaatccaaggccagcctggactccatcgtgaaaaataagtaagactggagagagagcttcagtggttaagagcactggctgttcttcctgaggatctgaggttcgaatcccagtggcttagaactggcccgatgccctcttctggcctctgccggtattgcatgcatgtgatgcaaagacatacatgcaggcaaaacactcatacacataaaatattaaaataagtaaaataagagggggggaatgtattaaaactaaccagccttgctttctgtgcaattacatatgtaaatccatggaagggaccctaggaccaagaggcaccccatattgaaggttgcttaggtattgtcaagagtttagaggtcccatcaaggcatcatccacttccaccacaacccaccatggtccttggctgccgcctggtggccacagttgataacttcccaccctgggactcccagtgtgagtgccagctttccagagaccctcccccagatctagggctacaaccaggaagaactgcaggcctttgctttggcgtaagttccatgtgatactaaatatattcccttctgatttattggtctttctcccttagtagtgctgaaaatagagccatgggtctcgcatatgttaggtgaatgctcaaagtcctgaatacatccctggccttctaatgtctgatttatgcaataagggagtcaagtagaaggctcatgtgctgtctcgggctgcctatcagtgtggctcaagccgcaggtgccagcacaagcattctcagcagaactaccatccactttcctcctcaacataaacctctgggcattgtggattcagactggcaagtactctcctgatggggggaccagtgcctcctgctggaccctcgcctcccttgaaccttgtttcagctttcacatacagctccctcactgggggcctctaggtaggaccactgagccacactctagcccatcactgggggattctaggcaggggctctcccacttagccacgcctccagagcctccctggggaattctaggcagggctctaccactcaggggctctaccactgagccacagccccagcccctccctggagccatgctttagtacagagctttctgattggtccttggcttctatacgtccttcatcccttcctgactcagcagctagagcaattcagtcgaaatgaatactagatagtgtcactctacggctccttcccagccaattgctcccacagacctcattcagcaaccctgtgtccctagcctgagctactctgtgtacagtgttcatgatgagaatgagagagagagagagagagagagagagagagagagagagagagagagagagagagagctgtttcttaaaattgtttattttaaaacatgaaacccaagctgaatagagaccacagaaattacatggacaagaactttagttatttgccaagaaaaataaagttccccacagaaataaaaatcaaaccccaaacccagtttaaaaaatgaaagcacagcaacagtaacacacagccatggccctacagaggctggaggggaacttggggctggctcgattcagatgacatagtccactgggggcagatgcaggcagagggaccgtaactgggaggcaatctcacaaaatcacatatgggaggaagggtgcggcacaccaccgctgtgatgaaaaacaaagagaccctggtcacctgtggcccaccagctagccaccttctgggccggacagagctgggaccgggtagggcaagctttggagctggggtcaagaattgcataggcttgaaggatgctccaggccgggatcttctgctactcacataaaccagagagtgttggttggggtgggggcctccagtcctatcagttttctcagccagatccctcctcctggctcggcaagggatcgggctctggtttggtggcttagccctccttgttacccaccagagctgtagggtccccttgggtaatagggactggggaccaatcacaggcagctggcactggactgctcactccctggggatgtgggggtggaccactgggattgagtaggtaagtggcaccccagaaatcaggaaaacgaaatgaagccaaccgcagtggtaggagccgtctcctccgcaggggtcagggcgagaaacccctgctttcatttcccctgcttcctttcttcagcctcggtgagtgaaacgtcacagatgggggcactcacgcacagaaggtcaggactcccgagacagcacaagttcacagccacgtccgggcagtgcccgcctctcatgctatatacattcaccttgtggcctgctcacggccagggggcagcatttgtgcttctgagaggccccagggcacacccaggcacccaggcagggataccccaaacctccctccggaccttaggccaggaacatacccatagtgggcaggctggctgcagctgggctgctctggccctggaggttcctggcgccaggccagttggagtcaaggccagggtcccctgcactgatgttgtcgtgcttaggagctacagatgccccgactgggacccctaggccctccgagtcctctgcccactccttttggtcccagacaccagcacaaagaaagggattttggggaaggaaagcaacgtggagcctctcccctctgggggagctgaagcccagggggttctgggatccgtagctgccaggttgctccaggagggccacaggtctgtaaaccactgggtcccagccttgcccctcccaccacatgctgctccactggcccgtagctgcccatctcacagaccagagctcacactggctggctgggccagggtagaggctccaggtcctgatttggaagctaattcagcccagaagcacagcaaacatcacacactaaagccaaaagcaccttaggcaagcggtgttctgggtgtggggggctgaggccacatggacttcagtccccggaccccaggacatgctcctcctggggcagcacctgcctggggaggggtctctaggccctttgagtagcctgtgggtctggcccctccctggcagcaccccacaaagaaatgaccactctagccctggctccaggctagacttagggtcacgcttgctggctcagggtcagccaggagtgcccatggcagctgagagtgaggttagtggttagtcccagcggggggtggggggggccttctgaggctgggggcacattcacagccgtcacaggtccagcccccaaggctgggctccagagggcactgccgcttgtcctgggtgagaatgaaaccgagaggaaagtgggcagtgtcctgcgtcgcctatgtcccagactgccctggagatgacaagtgtggtcagtgcaaaaacaaaggggaagacaaagctgccactcttcaggaatgaatgggaaagagggtttggcaccaagaaggtggccagcactgagaggccagggagtgacctgggctcagcttggcacctgctgtctggggagggctggctgggcactgagggaagagtcatgtggggaggaggtgtaagaagagccccaccctagaggcagctcagaaccaacaggaagagccaagtaagccaggtggctaagggaaggcaggcgccggacgttgcaaagaccagagagtatgaaggggccgttcggtgatgagcaggtgggcgccaggcacagggtcccctgcctgtgaatggagatgggattctcaggagtgtggcggtagggcagtaccaggaaaggctcgctgtagctgtggggagggggacgcccagagtgcaaggggcagcatgaagggtcacctgtagaaggaacgcaggcagggtggaagcacccggcacagagcagggctcagggagcccaagaggacagaagggcaggggagacggaggcaggcagggtcaggttgctggtggcagcgactgtccaggtgagcaccccagaagcctcacttcacaggctggcccggagctcatgctgggcacctccatgcctcctgcagggtgggtatagcgggggggccttcaggtgtgcctagggctggcccggtgtggcttgtggaaggtccagcagggcggaagcagcggtgctggcataggaagggtggggcattggcacgtgggggcagatggctggccggtgtgcggtctagtgcccgctgccgctggagtcggggcgaggctggctcgtggcgaggtatttggctctcatgctggaggtgtactagaggagagagggaaggagggagcagggtcaggtgagttcctaggtgggggctgagcagccagcagcctctttgatgtggtccttggtagggtgagccacagccgacccttggggagagcatggttggcggaatcctaaggtaagaggccactggcccagggctggaccaagggctgagtacaggttagggaagtgatggtacctagagtacaaaggtcagcctctgtagctgaggctggatcacccaggcaagttcccttcccagtgaaggacacccagtccccttctgtcgctaaatcactttcagagtcccagtcagatctttgccacctccagtaattcagctcaaaggctctgaatgcatcacacacgctgagcacaggaaggccacatggaccccatctctatacctctgcctcagagctgtgctggggtcagggcaagggctcccagggcaggcccacaggaagctaggccacagaccacaactgctgagtccactggagcctcctcccctgccattcgactccatcacccccaggaaatgggggcccttcaggctagagtgactctggcccagcccttggatgggaaaactaactaaaggatgtgtgactcgggatagaggtgactgccccattctgcaggtggcctatacaccttggccgccttaacaacagcaccacaggctccaaggtttgggcagtgtgtccacgtgcacgcatatgcacaagcacaagtgtgtgtgtgtgtgtgtgtgtgtgtgtgtgtgtgtgtgtgtgtgtctggctgtctgcctgcttgcctgcctgcctgcagaggaacatgcctccaatcatgtgccaaggccaggtagtgagtgtgcaagagtttgcatgcctgaggcagggacaaaggtcaccagcactcagaagaccaggcaggtggatccccactcaccccaccccagggagcacaggctggctccatagttccccgatgagagacaatgctttctcccagggtcctgagtgctttcctgagacattctaggttaaggttgcaagcggcctatgaggcggccatggtgcagaggtgggaagagcaggggcccagagccatgtcattccatggacatgcagaggtgataaggaacagggggttgggatgggacaactggtgggatgggacg

SEQ ID NO: 1608 - DNA, 1192 bp, Mus musculus
ctggcactgggatagatattacgtgcggccgccggccaccatgctccagcggtgcggccggcgcctgctgctggcgctggtgggcgcgctgttggcttgtctcctggtgctcacggccgacccgccaccgactccgatgcccgctgagcgcggacggcgcgcgctgcgtagcctggcgggctcctctggaggagctccggcttcagggtccagggcggctgtggatcccggagtcctcacccgcgaggtgcatagcctctccgagtacttcagtctactcacccgcgcgcgcagagacgcggatccaccgcccggggtcgcttctcgccagggcgacggccatccgcgtccccccgccgaagttctgtcccctcgcgacgtcttcatcgccgtcaagaccaccagaaagtttcaccgcgcgcggctcgatctgctgttcgagacctggatctcgcgccacaaggagatgacgttcatcttcactgatggggaggacgaagctctggccaagctcacaggcaatgtggtgctcaccaactgctcctcggcccacagccgccaagctctgtcctgcaagatggctgtggagtatgaccgattcattgagtctgggaagaagtggttctgccacgtggatgatgacaactacgtcaacctccgggcgctgctgcggctcctggccagctatccccacacccaagacgtgtacatcggcaagcccagcctggacaggcccatccaggccacagaacggatcagcgagcacaaagtgagacctgtccacttttggtttgccaccggaggagctggcttctgcatcagccgagggctggccctaaagatgggcccatgggccagtggaggacacttcatgagcacggcagagcgcatccggctccccgatgactgcaccattggctacattgtagaggctctgctgggtgtacccctcatccggagcggcctcttccactcccacctagagaacctgcagcaggtgcccaccaccgagcttcatgagcaggtgaccctgagctatggcatgtttgagaacaagcggaacgcagtgcacatcaagggaccattctctgtggaagctgacccatccaggttccgctctgtccattgccacctgtacccagacacaccctggtgtcctcgctccgccatcttctagcagtcgtggttgaaa

SEQ ID NO: 1609 - DNA, 1137 bp, Mus musculus
atgctccagcggtgcggccggcgcctgctgctggcgctggtgggcgcgctgttggcttgtctcctggtgctcacggccgacccgccaccgactccgatgcccgctgagcgcggacggcgcgcgctgcgtagcctggcgggctcctctggaggagctccggcttcagggtccagggcggctgtggatcccggagtcctcacccgcgaggtgcatagcctctccgagtacttcagtctactcacccgcgcgcgcagagacgcggatccaccgcccggggtcgcttctcgccagggcgacggccatccgcgtccccccgccgaagttctgtcccctcgcgacgtcttcatcgccgtcaagaccaccagaaagtttcaccgcgcgcggctcgatctgctgttcgagacctggatctcgcgccacaaggagatgacgttcatcttcactgatggggaggacgaagctctggccaagctcacaggcaatgtggtgctcaccaactgctcctcggcccacagccgccaagctctgtcctgcaagatggctgtggagtatgaccgattcattgagtctgggaagaagtggttctgccacgtggatgatgacaactacgtcaacctccgggcgctgctgcggctcctggccagctatccccacacccaagacgtgtacatcggcaagcccagcctggacaggcccatccaggccacagaacggatcagcgagcacaaagtgagacctgtccacttttggtttgccaccggaggagctggcttctgcatcagccgagggctggccctaaagatgggcccatgggccagtggaggacacttcatgagcacggcagagcgcatccggctccccgatgactgcaccattggctacattgtagaggctctgctgggtgtacccctcatccggagcggcctcttccactcccacctagagaacctgcagcaggtgcccaccaccgagcttcatgagcaggtgaccctgagctatggcatgtttgagaacaagcggaacgcagtgcacatcaagggaccattctctgtggaagctgacccatccaggttccgctctgtccattgccacctgtacccagacacaccctggtgtcctcgctccgccatcttctag

SEQ ID NO: 1610 - DNA, 29322 bp, Homo sapiens
ggtggaggctggagtggggggcgcagctgagaccagaaagaaacagctaggaccccacctgaggctggagacacagccaggacaggggactctccacccagagagacgccataggccaggttgttggggacaggcctggactggtccccaggccccaccctgctgaggcaggccagccagctgcccaccccttggcctgggcatgtccagcttttgctcagtttcccagcctggcagggctttccgaggggttgcagggagaagcaggcctggccaaaagaccgccatgcctgaaggttcaccttcaccccctggcaccaccaaagaccccgcccaggggaagtcttggagcctcagcgcctcagaactttgggacttcctggcatatgggaggcacccggaggtgtgagcctgaggggttcactttcaagggtggctggagacacctgctgctggccatgtgggcctgggaggccttctggggcctccatcttcccatctgtgaaatgggacttggacctagatgctcttcaaggtcccttcttccaagtcttctggcaagagccaagtccaggaagctcagctccattgcgtcggcatctggactgagtactctgtgggtgccgggctgtgctgagggctggacgggacccaggaacagacaacaggtagagtggaggagggagcagcgaggagacttcccacaggggtggagacgctgagcactccaggcagacacagaggggcggctggagtgtggggatcctgggcctggcagggcctggggggttcggcaggcagagtgggccagggggtggcctgaggacgccaggggcagagccagccctcccaactgggcagtggggagccaagggagggtggcagagccgagccccatctctaagatatggggacagccctcagagccagctcccacccagctccagctcaggacaagcagtgggcatggaactgagatgcaggaaggccgaggtctggagacgcacgtgggctccccgaggtgacctaggggtgggcggccctcagccctgcccggagatccctggtcctactgagtcagccaccggggagaagataagggaccgccaggctcttaaggggcctgacgttgctgttgggtgaagtgcccgcccagaatgacctcagaggctgccggggccacctggcatatcaccctgcccgtctccgcagcttcctctggcagtgggtggatgtataatgtccgcccgctgccagagggttcacggcaccacagccctgctgagccctgctgagccccagctgggtccgacctcctgggtaccccagggacggggaggccaggcacgggggttgctgtgcgggttggacagtggtgatggtggacagagccactcccaagagtgttagagacctggggtgggggcatccaggcagaccaccctcaccccaccctgtgggacccagaccagctcacttccctctctgggctcagcttcctcatttgcaaaatgaggccaagagtcacacccggcccggcctgtgaccccggagccccctccagcctcctgcctcactctggcaccaggcctccctgcagcttgcagagcaagcggggtaccgtctccccgaggtgcagcctggggggctgtggcaggtgatgggagcagctgtatttgagggcagggtctgtcggggagccccccagcgtggggagaggaggagggaccagggagtgtaacctggcagcccgcagcagttccggctgctgcttctgtcaatacggccttcctgttttggagattaaaccccggctgagcaaacagctttccaggcggcccctccctccaccccagccccagccttgtcttcaggtcctaaggctgggaccacctggaggctgtgggggtggtgggggatggaggggaccaagctttgccatccctgccctcaccaaggcctggaccacagcctgagcagcccagcccctgcccctgccgcagcctcctcccagccccccgccgtgggctcccccggaacccccccgtgcgatccttccaacccagggcagcctcactgtcctggacgcccggccactgcatcctctgcccttgtgtgacctcctgcaagaaggcgggagcacgccgttcccgggcctcatggccagacacaagcccaccttgtgaggaccccaggcgaggcaggagagccaccgcaagagccccaccaaggcacggccaggggagggcccgccatctcttggatggtttctgcgccgtggccactgacattgagggtggatcattcttggttgtggggctgttctgtgcatggggggctgtggggcagcctctctgggccctataggccagaccctactgtctgttcagccccagcccggtggcgacaaatgaaagtgtctccaaacattcactgtcaggtgtccccagaaaccaagacgagcactggataaccccgtctgggcaagtccctagcagatggcgtgcacagaaacgggctgcagagagaggacggtgcctccaatgcttggactttcctctgatgccagcctcagcccagcctctgccgccctgagagagactctgccccacctccccacacccgcctccaccatcccctcctgccagggtcccacccctgagcaacacggccctgccttctctctgcaaatccttcccagactaagctgcaacactggcagagcctcccaaggaagggaggagggaggacagaggccaaggcggctcctggccaccctcgcagcttcctccctccctggccacaaggacccaaagctcagagggatggatgaacagacaggaaggctcaggctggacacgtattgtatgaggtgggcctcagggttgcttttcctcctagaatgccactcagagccgtccctcttgctcgtgaacctggagccccctatgtctcccccagtacccctgcattctacacctagatcctcaggcttctctttatctccagcctcacctccatgaatgccccacacacctgtgcctgaccacacaacctccacctccacctgctcccacacccctgcccaacttccacctccacctgcttcacacacccctgcctgactgcacaacctccacctccacctgcccaagccttcaagccccagggcaaatgtcaccatcttttcctggaagactttccagaagtcccctgcctcccagccccagcccacagtgggttctccctcgtctgggccctgggcacctttgggctggacccatttttctaacccctgttgaatcctcacctactaccttcccccagtgccaagcagatctgggcatggagcaaatgctcaggaaggctgtgggatgagcacatgaaatggatggaaggatggacggacagatggacagatggatggatggatggatggatggatgagtggagcccaacaccagctctcaggtcctacggaggtggcctctctcagcaggtgtgatcgccattcctggggacctaacctccccttcttctgcttccagagcagcctggaatatcctttgatgctgtatcgtcttccctgatcctttcaagggggaaagatggcccatggtagcgatggggagcctgggatcagggaggtacacaagcccaggatcacatagcaagcagggctcccctggggccaagactgacccctgctccctccacccggcctggagcccctcctcccactgctctgtatcccatcccactgacatgggcacggggtcatgactagggtggggggtcatgcctggggcctgacaggcaacaccgtggccacagcccaccccctgcctgctgtggctgccacacaagccagccattcttggcaagacaaaggccggctggggcagggtggctctggtgcctccctggtgggtgtctggactctgcaggacgtcagtaagtggatcctggtggctgcgctctgatgctgggggctgcaaatcagattagccccatccagccccatggcccagctggcctcagacagaagcgccagaaagaggcgcagctgccagcccaggcctgccgtcctcctggtgtggacaagccctggcctccaggctgaggccccttgctgttcctgctgtgggcttaagggtgtgccacctcttctttctggccccctggacccgtctgtaagaccaacagttagagtgagaccccctgaggccttctggaggtggtgtttggaaatgcccccagggcagggcaggcacatagtgcctaggcactgggaattcaccttcagcacagccctcccccaggccccaggccctgtgcgggctcagaggccagcggcagccctgccaggtcttctcaccctgagacctatgctccccagggctgggcatttgggagacagagtcagagaggcgcctttgagccctctgtgtatctgcacatccacccatccatccttccatccaacctctaccaaccaatgttcatcaagcacctgatacacacaggcactgctctaggccctggggcacagccaagaatcacatcacggtcctgctgtcaagcagctgacatccagcaccctcccagccacccgcatgcctctgtgtgtatgtgtctgtccatctatccattagaccatctgttggtccatctgtccattcacctgtccatccatccatccatccatccacccatccatctgtccatccatccatccatctatccatccatccattcatccatccatctgtccatccattcatctgtctatccatccatccattcatccatgcatccatccatccgttagtctgtctgtcctttcacctatccttccagccatccatacatccatctatccatctgtccattcacctgtccatccatccatccattcatccatccatgcatccatctgtccattcatccatgcatccatccatccattcatctgtcggtctgtctgtccatccatccatccatccatccatccatccattcatctgtctatccatccatccattcatccatgcatccatccatccattcgtctgtctgtccattcacctatccttccatccatccatgtatctatccattcatccatctatccatctgtccatccatccatccgtccgtccatccatctgtccattcatctgtctatccatccatccatccatctgtccatccgtccatccatccatccatctgtctgtctgtctgcccatccatctgcccctccatctaactgttcatccatccacctttccatccatccatctattcatccatccatccatccgtccctccatctgtccatctgtctatccattcattcatccatccaaccatccatccatctgccaatctatctgtccatctgtccatccatctgtatgtccattccccccaccatcagttcaaccagtgtttactgagcacctactttgtgccaggccctgacaagcagcaagaggcagcctcttcccccagggacacagacgtaaaggagcagctacaacctcatgtgatcagcaccaggatgggggtagcagagggggatggggaggacgttctaggaggggtagcccttggtgggccctgcagggtgcctcaggccaggatgccccccgaagccttgctcagccactgaggccaagtcggctgaactctaatgggcctggcctctctgtccatgcctgaccccagagtgcaggcaaaagggccaggccactgttggaaaggccgtggcttcacggctgcagagcaccaaccccaaggcagcctggtgggcagggcgggtgaggcaccagccatatccctattacagagtcaagtaacgtcccaagacccacagaagggcactggcccaagaccacacagtgggcgaggggtctgggcatagcaggcaggcagggttgggaatggtgggggtgctactcacagctggagtctgctagtctcagggcagtgcccactccagctgcagtaatgggaatcagctgtgccaccctgcggtatccctcccccggccttgggagccggctgtgctgagcccagccaaccttcccatcaccctccttcctgccaccaagggctgctcacagaagctcctgggtcgggacactcactaggccacgcctgccttttggaaatccatgggccccctggcatctgggggcttcaaacactgccagttctgatgcctggccccagcctgggggttggcattcctgcgtctgtgtcaggagaggacagggaggtgcaggcttgcccgagccacagccaccaccatgctgagtcctgtccaggagtttccatctctgggcactgctactggcccagaggaagctggttcccaagacactgagtggggccgctctccatcagccgatgagtggacaggcgcctcggatggcttcctgccgagttaatgggtcacccattatgtctccacagatcttcccaggaccctgcaggaaggcaggccagagcagccccaaggaacagcccgggggagggaaggcagatggccacctcaaagccagccccgagcccttcccctctaggcctgagtgtcaagggcagacccagcccatggctttggggacctggtggcactgactccagcaggagaccccccgggctgagccctggcagttagaggaggcctggactcagatggggacagaacactgtctcagcctgatggcggctagaggaggagggtagggcccctggtcatgtgggtcctggctccgtgggcctgctttccacctgacctcagcaggcaggtctctcgggccattcgcacacccagctgcctgggagccccaaactgggactggtggaggggccctgcagaggggaagactaggatccaagaagcccatgaagccatgcgccagggccagagctggcctgcctggtctggatggtatgtcatccttgtgttacaagtgaggaaactgaggctcagggagtaacaccaccggttcaaggtcttaaagccgagaagtggcccctctgggttcggaaggcaggctgggccctggggcagcctctatccccagcccctcttccccaggaccctacggccccaagaggcttcactggcaactcggtcagccctctctagccccctccccagctcccctttgtcctgtccagggctgagcaccatcccacagcccacttccctaccagggctgtgtggcccagtgggcccctagagggagacctggggtctggatggggagggaagtgtttcaggctgaagctgagcctggggaagcgggcgggggtggctaggcgggccaccccctcaacagttttcagacctcaagaagtcaccacgaaattccattctcctgacagcaaagaaattgattcactcttgccaaagcctgcggcccccacaagaatgctgtaaagcttcctcccgctgcttccagacaggcagcagcatcaggtcccccactcctcccattcctggctacagagagacgcgggaaccccccctacccagttctatgcatgtgcccctgccaggctgggccatccacctctgtatggtcactcccttggtacaatatcccccttgctttctctacaatgggcacattgctcccacgacctgctgggtcaaaggcaccgcagtcaggggtagctggggagcaggagttgcgggggtggggcggctcagggcaggaagccccatcccctggcctgggaactgtggggagacggactcacagcatcttgtcaggtggggtgcagggtggcatggcacccaccatcggtgccactgatgtaaagtccaggtacagagcacaacccgtgcacatatttgggggcttggccatgcttggctgcaggggattgaggagggattgggcctcaagaaacggggctgggactaagtcacgaggtgcgtgaatatcaggcgggactttaactcagccagtggagagctatggagggttttgctctttgtgtgggtgtgtgagtggctatgatcctagttgtccagctgctgcgtggagaataagtaaagcaggtaggataggagtgggtgggatgggggtggaggctgcccaagtgattcagggaagagatgatggggatggatgaggctccgtctctgaaacaattcagatatgggagagcctgaagtcagcggtgtgactgaagcacgtggggtcatggacacccctcagtccggaggctggggctgggctgggactcagctgactttgtgggggcagccaacccagtcactgggtccttttctccccggctcaccctcaagcctctccagctgcatggaggctccagggctaggctctggctgatcggaaggggtttatggcaggaggtgacgccatgggagacttgtcacttgggcacagccagcaccatctgctggggcatctgctttcggaggtggtgactgctaattacctggggccaggaagaggcctgggaacccccatcccccacaccacccagcgggtacaggggctaggggtggggcccctggggccctaagagcaaatgggctacagcgtccttagcggggggagagggtctgacagtggggccagacatttatccagtgaattttttcagagcacctactatgtcccaaaacctgttccaggtctgaatgacaccaggtcgctgctgtcttgcggctgacattcaggtagaggtaaggagaggggctccaagggcacttaaagaatttaaaatgccatctcaggcgtgaacataactccgaggggggcagtttagccacggtggtggcggtggtggtcgtggtggtcgcagagaccctgcttaggagggcacgggaagacagcgcagccacgggcagagccgcctccgtccacgcttccggaggacgtggcgggcagggggctcacaccctgctcaggcgacccttggccacttccgggcccctcgcccctcaccctcggctgccggcgcgcattcctgccgcccccgctcgtgcgaggggcgggcccgggcccgtgggaagggccggggatgggggccgtgtgccggggaggcggggtggggagggcgcacagctgggccgcatctggcccgagcgcaaggagaccaaatgggacagaaggcggcctttcatccggcgagggaagtggcggccttcgtttctcctcgccatggggcgcctgaggatttcggggagccaaccctcccgacggagggccaggatcgaggaaatcagccagggaggaaggagtggaatttggttctggtgctttctcgttagaacctcgtgtccccacctgcggcacaggtggccaagctcttgctctgtacaaataacggctcccctgaaccgagcgctcgggaagacccaggcgccaccccagtttgcaaggcctgccgcgtcccaaggggaggaagccgtgctcaggaggggaagcgcacagcgaggaagtaggatgtcccccgcggtgcgtcggagcccagagcccgggtctcagcaccctgcccgctgcgccgagggcgcgcccctcccgtgccgggacgcccggtgcatccccggacggcgctggccaggctgggtttcctcttcagggacaccggcgcgggccgggcccgtccccaagcccctcggcggcccgcaggggctacccggggcggggggggtgcggggcgtgcacgtgcgcgccgggggcggggccgctgcgccctctgggcagttcccagcccccagccgcggccccacgtgggtctgcgggcgtggagcggcgaccggcgcgaggccccgcccccgagcccgggagccaatgagcgcacgggggcgggaccggggcggggaggtttaagagcgcgggacactggtgctgcgctgctggactgcgccgccggagcgacgggcttcgggtcggtgcaaggcaggcgcacggggaagggcgcgccgcgcggccgccaccccaccatgctcaagcgctgcggccggcgcctgctgctggcgctggcgggcgcgctgctcgcctgcctgctggtgctcaccgccgacccgccgccgcctccactgcccgccgagcgcggccggcgcgcgctgcgcagcctggcgggccccgcgggggctgccccggcgcccgggctgggggcggcggcggcggcgcccggggcgctggtccgcgacgtgcacagtctgtccgagtacttcagcctgctcacccgcgcgcgcagagatgcgggcccgccgcccggggctgccccccgccccgccgacggccacccgcgccccctggccgagccgctcgcgccccgagacgtcttcatcgctgtcaagaccaccaaaaagttccaccgcgcgcgcctcgacctgctgctggagacctggatctcgcgccacaaggagatggtgagccccccgcggcctggactggcgggcgagcggggcggggacccaccatctggtccagctggtggcagtgtcccatgggagtcaggctgcatccccatccagccactagggccatctgtgggcgacgccagtgcaccccggtgcacccagtttgcctgctggggccactctcccgttacagttgtgttactgtccccggggccccgcctcctgtccagctccagagtcctggatggctgcaggaccctacaccagtctccagtgcttggggttggtgccctgtgatacttctcaccccgtaaacattggagcgcattcatagggcattatgtcctcaaacttccacaagcaaattctgttcggacccaccctcagctcagaccccttcctggggagaaaggctcttcctttagagaagtgaggggttctgacctctgggccctttcctcatcacagtgttaaggtacggggagggagggaagtcattgctggttggtgggtcctggggagtacatctcaaagaactccaggttttggggtctgtgtggggaccctccccgcacagtgcagtagtctctgaggcctgcaaccttgggcacagcccacttcagttgggcatcagcttcttacacacacataattaagacacaccccactttgaacatttccctcgaggccacagcaggacggttgggctggggcgggatggggacagtgtgtggggcttgcagtcggggactgggggggtgtctctgggctgggagatgcagaggcatttgctgtgagggtgggggctcagggaagaccctgcacgccttcctccctgctcaaaccccggagacccagggccttctgacctggcgctgtcctgttttggggcactgtgggtgggtgggagcagggcttggtgaggtcatgagggcgacggggaggggcagggtcctccctggtcctggcgtggggaaggggccctgggaaccccatggcagcctcctgggaacacagcgtcccattcccaggggctcagcgggctggcgggagggggcggcgggggccgtgggttttgtttggcggccgggccgttaggattcccagcgccgggcggctctcacgccggccccttgggcaaggtaacaaagcccctttctccagcgagaaaggcgtcgggccccttgtgtgcagctacgcgctccgtgggaaccgctgctggcgtgctggccactcaggttgcctggcgatgaggggaccagcgggcccccccagcatctcttactgacagtccttttggggcaccatccctgagcctggcccccccacccccagcactcaagccttactgctatgtgatcttgggcatccttcagccccactctgggctaccaccagctctgagcacctctcatcttggaatttggggcctttctccaacagaggggatgtggtcagagggctgggctgtgtgatcctgagcaagacctggggcctctcagaccctcactctgatctctgaaatgggggaacatggtccttccaggagcacgttgtaagagactggcaaagcctgcaggcatggggtgaacccggcgggcactcagggtcgaggtgggggccatcactcccttgagccctgaggtccctactggagggtcaccccaccaggggacaggttgaatctgccctcagcatcagttcaccagcacacagcaagcaaagacccccttgtggtgggtgatgggcaggggtcctggaaacccacagaagagggcccccctctcccagccctgcacggaatgactcagacatggtctgatgggggagatagaaagatgtcagggctgtgcggggggaaaaccccgagaggctgtgtgaggcaacagtgggcatctgacccacatgctgggggaagggagggaggagggaagacttcctggaggaggcgccatttgagctagactaagagtaaaaaagtgcccagaaagggcactccatccgggcatggtgatgaccacagcatgggggttgtgcaggaaacttctagcaactggagtggtggctggggggagggtcggttggtcagcaggggccgcgctgagatgggcctggagtccaggatgaagagcctggcctttggcccagaggttccccgcccctcccaggagcagccaggctgccgcgctgccaccacagcggccacaattgctggggagaacttggcatcctgtgtttctttgaatcgcggctccaggaacaatgctgcttcctgtgggtgtcccccggcccccgcccccgtccaccctcatccacccggctcttcctcctgcagccccgtcttcgtctggaaagttaggtggcactggggggtctgggtccctagaaggcagggactgggctggtctagcaccgcctcggccccagggtatgacctcaggctggtgcctgcacctctctgggcctcagtttccccacttgggcctcagctggtaatggcacccacctccgagggctgtcagggagaggaagggagagaatctgtctttgcactttgttctctgcccaggggagctctgttatgcccattttactgaagacgagactgaggctctgagcggcaggtgagggctatagcccagcagcgcctttttcctcccctcctggtggctcaggtgtcgggagacagttcgcccggcacccccgcaccccatagccccgccttctcagatgctgttctagaggcctccctgctccctgagctgaacaaaggtgactttaatctccgtagccttgggctgggtttttagggcaccaccaaatctcgggagaacaggcctcccttgatctcattaagaaagcattttccttttaacccagcggcgcagtggagcgtctgcaggggctggccctccgcctcccacggcattcctgggctgagattctggggaggccaaggggctgggtgcgagtctgtgcgtgtggctgccctggggtgtctatgggtgctgcaggaggggtgcatgcatggagaggcggagacccagcctgccacccccttagctctgggcctcaccctagtgagcatgtgcccagggctgggtcaggctggataaggatctgagactaccaaggtgttccagggcctctgcgggacctgtgtgtacagggaaggaaactgaggctgggtgggcatcagggggttgtcccttggtcagagcattgcccgtacaccctgggttttgcactcagccatgccagggtgcgccgggcggcacgcgctgggcgggccgggcagaggaaggaacattcctccccgtgtgccggcaggcccaggcgggcgccggcgactcctggccccgccctggcggccccctcctcttccgcagagcgctcctggcagggggcggccgcgtgctggcacaggtgggctgtggccttgggcaagcctgggtttccttgcctgagcagtgggaggggtgctgggctgcatgggtactgggggcccctgacctgggggctggggacacctgaggtttcctgccacaaccctgctgaccgttggcaactttgcagaacttcagggctgctttggctcagagtgggtagcttgtcctgcaggtcacccaggacaggggtgctggcccaaagggcagctgtggggtggctgcagtgctggtggctgcaccctacgcgcgggacctcatgcccagcctggcccggttaaccaggccagctgtatggtaatgggcggcgcggccactctgcttaactcggccgagttaaggccggcccggcgcccctctcccgccagcccaggacaaagctggcggacaatgcctggtgattcatcctccctccaggccctttgtccgccagggcttggcagccgcccagcgaaggcctttgtccccaaccccgagtgattgagacttggcttcccacagccgacctcctccgcctgtccctcccgccaccccgcctgtcccccgcctttccagcagcctccaagtggcaggctgggtgctgtgtcaataagggtgtgtgccctgccaggtgcacggggcgggtcgggaaccggttacctggcgggcgggcgaggcgcaccacctggctcgtacctcaccgcgcctggacgaccttgggtgcagctgtcgaggttggggagtgaggcccccatcccccacccccagggcgagtgaatgcgtgagctctggcccagatggcactgagatggggcacttgagcccttctcagcacgagtggggaaaccaaggcccggagaagggtgggtgtcagtgtgacgcagctgcagctgcagcaactccagggcgccccgtccggcccccacagatggccctggggtggggatgaagggctgcctgctgaaggccgattttctccttccagacgttcatcttcactgacggggaagatgaggccctggccaggcacacgggtgagccctggacttggggcgggagggggcccaggcctccatccagagccgaacgctccccctccagtctccctgcccctctgggccgagaggtcaccaagggcaggacagggagggcagtttactcatggggtttgctccatgccccgccccaccactcgggccccccaattctcatgcaaatgaagcccattcagccccccgggtccctttgagcccaggcagcggcaacaggtggcgggtgctgggaaaaagctgcctgaatgggcgggggcggggccgccctggaaggggctgggctgcgggagggtccacaggcccaagccccgagctagggtgggggaggctacggccgccgggcccagcttgaactagggggcttttctcgagcccctgggccctgtggcgtcccccaggccaggcccctctctgggagccggctcagacctactcacagccgctcccctgtccacaggcaacgtggtcatcacaaactgctcggccgcccacagccgccaggcgctgtcctgcaagatggccgtggagtatgaccgcttcatcgagtccggcaggaagtgagtgtggccccgggggacccccatctccctgcccgagcctggcagcgcccgccccggcatgccctcccccgatggccctgccttgtcctcaggtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtggtgagtgcctgcccctcccagtcccccacgcccacgcggagcgcacacccggagtgggggtgggacagtgaggggcagcagcgcctgggtctcaggacaccttctcccttctcccagcgtcctgtccacttctggtttgccacgggcggcgctggcttctgcatcagccgtgggctggctctgaagatgagcccgtgggccaggtgagtgccctgcacaggttaggccagcccggtcccaggctcctcgccactgtggggcctggcttagttcatcttcccagccatggggtgtccccagcctcctgtgtggcactgcccacttacttcctatattccacttccctctgggtttcagagggcagctgtgtttacggcggctgcccccaagcctgacctgctcagagcagccaggggggcgatgagcaccccaggcaccatccggcaggactcttccctgcacccagattccctccacagagagccacggagcacaggagctgtgcagggagtgtgccctggctgtggccaggggaggcagagggagctgcagcccagagctctcctcagggctcctctccctgaggagtgcagcgcctttgcctggtggggcctccccagctcccagcagatggctcccgcctctgctcactggtctgggcccttccctcccgcagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcagagctccacgagcaggtgcaccatcctccgggccccgccaggactccgagagcacaggaagggacgtgtggctgccgagaggggcgcagtggggtggggcactgttctaaacagggaggccaggcagcactccactgtcagccagggggggtcactcctgccatgagctcaaagctgtttatggcgggttgttttcctgccgtctcttctcttcactgtgatgcgcctactgtgcgtattttgtccacgctggcaatgcagccagccccagctggtccccagtttgggaccttattcctggggtgtgcagggcaggtgtccttccaggtccaagggaggccagggcagggccgttgcctcactcagggctgtgtggccagcctggggcggggcccagggatgtcgggcccctcccggcatcactccgcccgctccccacaggtgacgctgagctacggtatgtttgaaaacaagcggaacgccgtccacgtgaaggggcccttctcggtggaggccgacccatccaggtaaggaaaccccggcccagatgggcttgcgtagggtggcctaggggcgtcagggggcctcgtggagctgcagcagggtctctctaagcggcatgactctacatagaggtgtcccccggagtcctgcttgctcggggtggggccgccagtgttgtgggactgcaaatgggagctcagcacctgcctgccacccacgcagaccagcccctgctctgttcccacaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagcaatcctgggggtcctggtcttggctggaggtggggcctaagccccagggcagccagggtcaggagaggcacacaggtgaaggggaggcttggccttgggtgcaccgcatggagcaggtagataggaaacgcttagagacaactattttggaacgaaacctggcgtcactatagctgcctgctggtgactacaggtgcggcccacccagggtcagggtggtcgctggagcgtgagccctgtgcttccaggaggaacaggtctaggatgctgggggctctaggtcccagccaaaagcacaaccccaaggctctggcctggtctggccactggggagcccagcccctgcaggagggacagtgactcctgtgaccgggcctggggcctccttatccaacttcactcctgccacgagctcacagagtccacatcatcgcctcactttgcaggtggggaaactgaggcacggagcagctgatgcccaaggtccagcagccatgctggtgggctggggaggcgctcagactccaagccaggcaggccgtgggtccggccgccccacagctggtaatgctgcacctccctctcctgtgatgtggccccaggccccgaccccgctcaggggtggtgggaagagtcctggagagcaggagcagtgccggagcccccactgcagctggtcccagcccctgcagagatccagacgcttgttttttaaatacagcagctctgcggtgcttttccttcctcaaatccagcctttgagggtgactgagtaggggacgggtgctgcagcctctgcggggattccctcccctcaccctcctggcagccccggggcggctcacttcctcttcaccatgagcccccaccccttccctggggcttacacccttggcctggcactgccctggccgcgccccttgcaagttcctgctctggcctgaccctgcttcccccgaccccagggctccaggtccccctcctggtgcctctgcaccccccactctgctccaaggagacgacacactgtgaaaagtgcctctctatgggggggtgccttgccctcccccgtcgctgccccctccagaagagtgctgacgtgctgaatgggcctgcagagacccccttactctaagcctggctgggggctaccctggccttgggggcggctggcagggctgtgaccccaccttggccttggacggtcctgagtcagcagagcagctgcctggggggtgtggacagtgatggggatggcgggaggatggagggccctcaccgtcacgtggcctgacccccgtctgggtggctgtggtcctccctgagcacccaccatgtgcccacccacttctcataggacggcataggcccctcttctgaacgaggaagctgagactctggggtggggcggggggggtcgtgacggaacaggctgcgggcagaggctgctggcctccttcctgcccggctgactcagaggcttggggccttctgccctggccccgacgctgtccccgcctgcagctggcatcgcctccccacagagctggtggggccccgggggcagaggtgtggctggacccaggggtcggacagacccatggatacagctgtgggggccctgccagggcttggggagtccccattaatgttcatatgtccctgtgtgtggagcggggtgggagtgggggctaagtgggcatcggggagagcagaggagcaagaagtggggtggggaggaagcccggctcctcccgaggcctcgacctctccatctgacaaatgggaacaaaggtaaatgcagtccccgggtgctggaggtcagggggtgttttggaaggtgcacaggacagcgcatctggccccttcctcttccaagctgagggagggacgtttctctgccctcaaaaggggaagcaggcccagcagtgtcttaggggaatgaggcagcctgacctcttccatccaccgcccccccaccccccagaaggtgactcacccggcaggggaggtgaagtcattcctcccccaggtacattctggggacagctgtgtcccacccaccagtggtgccatcacatcagattagaggtctggtcagaaaggggcctggctggtccctggggctccatgtccccccagtctagcccagccaggccccctttcccaaacttctgatcattaatggggctttcaaaacaagtaaaactgcaaccacaggggctgcagggcgctcagcgagggtggcagacctcagccgccacccctgcttccgttctgccaggcgagtgcctggggagccccaaggctgcttggggtctgggaggggctgctagggtggggcgcctccccactcagttgaaaggaacttcccttccactggggccatcagggccaacttcctggaagaggtgcctctgagctgaagcaggaaggctttgtcaagatggagtagggagagaaggggccttccaggtctcagcacagcctgggcaaaggtgcagaggtgggatccactgggaggactggaagcctgggaaggagggcaggcaatgcagttgggtctcttgatcccccctccccaatcacagacaactagggctctccacaggctcagaggggccagggccaggctgctatgtgacttcagccattcttgccgggtgggcctggggtcagagggaaagcagggaccagggccagatccatcttcgagtctgtcagaacaatgggcaagtcttgttccctgctgggtccatgtgcccacacagcctcagccttcttagatattctgcagggtgaccccctgcttctgagcccagccccaccttctgagcccagaattggacacacaggaaggcccttggggccaggcgtggtggctcacagccgggctgtgccctctgcctggagccgcagcctggatgcctcccaccccacatttaggcttcaggccccacagctgcctcttcccagaaccctcccggcacgcacttcggcgactcttacaagtacctgttcagcgtcagccttcgcccaggagtgcaggctggggacgagggcagtggccacctctgccggtcctgtcagcacctagtgcaatgtccagcccaccgtgggcactcaacgcaggcggctgtgctgccgcaggtcacagcaccaatcagacacccccatccccacacacaccctgcaccggcccacgcggccatcacactcggagcacacgcgctccgatgtggctgcactgttggcacacgcacaggcgcgcacgtgggcgcatacacgccggggcgccctgacctccccgcacgccctcccgcagccgccccggcctctgtccccacgcgtgtcacacacggctgggtgtgctcgctcacgccgtcccgcgacgttgctccagccggcgcccggagctcgatcgggagagctgctgttggccgcctctgcctgccagcgtttgccaagcggtttccatggtgacacatcttggctccgacaggaaccaaggagtgtggggaagagggtccccacggagggggcgaggcgaggcaggaggtctctgcgtcttcaggctcccggcaggcatggggggctccacgagtgcagacaccccccaatcccaagccaggcttgcaccccgagaaggaggctctgggctggtccctctgggctgcctggcacaggggctgacttaggtcagtcagtcattcaacaaactttctggaagagccactctgtgctcacagccgggtctacgatgctgcccaagacgtggtctcgcaagaggctcggagtcgaatcctgaggctaaactgacgtcccgccaccctactgaaggccccatctagcaggttggtccgtggctgcgtaagcaccaaggcccaccgagcactttctcaaaggggggctcccctctgtggtagatcagttacaaacgtgtccccgatgccccactcctcccctgaatcaccacgccctttgctgtgtgactttgccccaactcctgtctagaggtggcgtctacttccccatccttcaatctgagcctgtcttatgacttgctgtggccaataaaaggtgacagcaatgacattcccagttctgagcttaagcctccagggacatgcgtgcctctgcctgctctccccgactcctgctatagcacgagaacgggctgggctgctttgctggaaggcaagagggccatggagcctgggtcaccctagctgaggccatcctggactagctagctcccagctgcccacagatgtgtgagtgagcccagctaggacttgccaggcctagcaatgagcagcagtaccaccaggccctttaatactaaggacatgtgaagtcatgtgtttggagctatttgttactcagcactagctacctgatacccctctctctagggccctggccagcagctgcccaacctcagttagcacaggccagaggctctaaaagttcccaggggtgctaagaaccaggccatggtgacagctggattccgctggctaacagtgccagagggtgccggggacagagcttgtgggagggggttcccatgtcaagtccatggcaggagctactgaagcagaagcacgagtctccactgcctttctttgcctcggtttttccccctgtgaaatgggcccatcaccctgtcctgtctcctggggacccctggtaaggtagcgtgtgtggcagctggaaacagacctactacgtgccagccccgggttgcaacctagggagagaggcccattgctgccttctaggttcccacaactgagaaggcagcgtcactaatcccagcttacagactggaaacagtggggagaggatgagtggcttgcccgaggcccaggacacacaggagcaggtgggcatggccacaagccccggctgggtctgagctggtggttatcttcatgtttttctccctgtggtcacctttttggaaattttttttttttttttttttttttttttacatttgactattttcttgtttattggtatttctttgggagattttttttttttttttttttttgagatggagtttcgttctttttttttttattttttttttttttattgatcattcttgggtgtttctcgcagagggggatttggcagggtcacaggacaatagtggagggaaggtcagcagataaacaagtgaacaaaggtctctggttttcctaggcagaggtccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacggggttggggataaggtgacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcacccctcacctcccggacggggcggctggccgggcagaggggctcctcacttcccagtaggggcggccgggcagaggcgcccctcacctcccggatggggcggctggccaggcggggggctgatccccccacctccctcccggacggggcggctggctgggcggggggctgacccccccacctccctcccggactgggcggctggccgggcggggggctgacccccccacctccctcccggacggggcggctggccgggcagaggggctcctcacttcccagtaggggcggccgggcagaggagcccctcacctcccggacggggcggctggcccggcggggggctgaccccccccacctccctcccggacggggcggctgccgggcggagacgctcctcacttcccagacggggcagctgccgggcggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggcgctccccacatctcagacgatgggcggcggggaagaggcgctcctcgcttcctagatgggatggcggccgggaagaggcgctcctcacttcctagatgggatggcggccgggcagagacgctcctcactttccagactgggcagccaggcagagaggctcctcatatcccagacgatggggggccaggcagagacgctcctcacttcccacacggggtggcggctgggcagaggctgcaatcttggcactttggggggccaaggcgggcagctgggaggtggaggttgtagcgagccgagatcacgccgctgcactccagcctgggcaccattgagcactgagtgaacgagactccgtctgcaatcccagcacctcgggaggccgaggctggcggatcactcgcggttaggagctggagaccagcccggccaacacagcaaaaccccgtctccaccaaaaaaaaaaacgaaaaccagtcaggcgtggcggcgcgcgcctgcaatcacaggcactcggcaggctgaggcaggagaatcaggcagggaggttgcagtgagccgagatggcagcagtaccgtccagctttggcttggcatcagagggagaccgtggaaggagaccgtggagagagagggagacggagagggagagggagagggggagggggagggggagggggagggagagggagagggagagggagagggagaggctgtgtgtcagaggttttcctcggagtttcgttcttgttgcccaggctggagtgcaatggcacagtcttggctaattgcaacctctcccctttttggaaatattgtacttcctgagctaactgcacttacgaggtaatgattggtgtgagtttctagtctctgtttgtttgttttttgagacagagtctcattctgtcacccaggctggagtgcagtggcacaatcttggctcactgcaacctctgcctcccgggttcaagcgattctcctacctcagcctcctgagtagctgggatgacaggcacctgccaccatgcccagctaatttttgtatttttagtagacaaggtctcaccatgttggccaggctggtcctgaactcctgacctcaagtgatccacccgcctcggcctctcaaaatgctgggattacaggcgtgagccactgcgccccggctcgctcctttttttttttttttgagacagagtctcactctgttgcccaggatagagtgcagtggtgtgattttggctcactgcaacctttgcctcccggattcaagtgattctcctgcctcagcctcctgagtagctgtgattacaggtgcccaccaccatgcctagctaatttttgtatttttagtggacggggtctcaccgtgttagccaggctggtcttgaactcctgagctcgagagatccgcccacctcggcctcccaaagtgctgagattacaggcgtgagccaccacgctgggccctgcagtctcttttcactgggtactgcggttcagtgttactgcctaggggcagctgatccgcagagcccctccctctctgagttcccccaggccagagctgagagccaggctctccagatccctgtgggagggccttgtatctgagtccagttttcctccagcacgaggcctggcatttaattacctgctatcttgtcagctgttcagtgttcctggcctttggatatttcacccagcgtgtttcattgtcttcagggaaacggctggtccaggcacctagcctgctgtcaccgggaagggacatgtgccccgaggcggggctgatgtcactgctgcaccctggtggggcgcaccagcccacggctgtgccacccgggaggtgcccttttgttggagggcatttgccaaaaccagcaaacttgggttctcattctgtggccttgaggggtcagggggacagaagtcagggccagtcctgcccaaaatggggagcattatagaaaacccttcccaccttaagctgaaaacctaaaggtctacactcttagggtaagaatgaaacggaattagccctgctccctccacacgaaagacacttggtgctaagagaagcaaaaagaaaaagttcttcagaagttagggctacaggtcttctctagcacagatttgaggtgctagcacagatttgaggtgctgccaagaatgcagagaactccaagcactcaatgcgttgtttgttttgacatagggtctctctctgtcacccaggctggagtgcggtggtgtgatcacggctcactgcagcctcgaactcctgggctcaagcaatcctcccacctcagcctcccaagtagctgggacttcaggtgcataccaccatgcccagctaattaaaaacaaaagagatacggcaggtggatcacctgaggttaggagtttgagaccagcctggccaaactggtgagattctgtctctactaaaaatacaaaaattagccaggcatgatggtgggcgcctgtaatcccagctactggggaggctgaggcagaattgcttgaacccaggaggcggaggttgcagtgagccgagatcacaccactgcactccagcctgggcaacaagactgagactccatctctgaacaaaaaaaaatgtgtagagatggggtcttgctatgttgtccaggctattctcaaactcctggccttaaacaatcctcctacctcggcctcccgaagtgttggaattacaggcgtgagccactgcgcccagcccccaggaataattttaaccaaaataaattggccgggcggagtggctcacgcctgtaatcacagcactttgggaggctgaggtgggtcaatcacctgaggtcaggagttcgagaccagcctggctaacatggtgaaactccgtttctactaaaaatacaaaaaaattagccaggcatggtggcgtgcgcctgtaatcccagctactcgggaggctgaggcaggagaatcacttgaacccaggaggcagaggttgcagtgagccgagatcgtgccattgcactccagcttgggcaacaagagcgaaactccatcacaaaaaacagacagacagacagatagataaaaaataaacagtgctgggaaaactggatatccacatgcgaatgaatgacactggacccttgtctcagatcattattattaaattaactcaaaaagggttaaagaaagacttcaatgccatttattttgagtagaaataagtcatttctttaatacatcaaactgtgggatttcttgaccttgcttctctcctggtcctggcttccccagaggatccaccgggctgggctggagccctggggctggcagtgtcccacagaaggacatggtgctgcctcccttggtcctgagccccagtggcagactctggttctgctcagtagcagtcggcctcgtccccctgcaggaagcctcccgtggccagcatgtcctgcaggagggactggggactcttttccacgtggtcgctgctctcggccagcgtgctccgcaggccctccaggtctagggacctgagcatggccagcacagcctcaggctcctggtcccctgggggctgggcctgctcacccgcccgccacctcggcagggtggcctctgcggaggcagtgttggggctgcccctggcctcccgcaggctgctgtaggaagcaatcttgtccctcaggaagagaaggaggtcacaagacttctgcgccacagggcggtcgcagtcaaacaaggcacaaaaggcgaagtcaaagagccccacgtggcagagagccctcagtgcctcggtgagtggctgggctggggccacctcgggtagggccacggcataggggcagtgggtacgcggcggccccaaagtctggcccaggaacacgagggccagctccaggccctgggcgcggacctcccagtccaggtctcggctcgccgcctgcagcacagtggccacgaactgctccgtgtcctgggccgcgtcggcgtggccgtcccgcagccactcagtgaagacttgcatgaccgcccgccgtgggaagccctccgagtctacggagaggatgtgcaggagctccaggaacaggctctgggggacagggagcaagtgcggatggttggtggggtggcaggagcgaggctcccgcaacaggactccggtacatgatgggggctggccccggacatgcagtctagggccacagcccgctctgacaccttcccatgctgcgcagtgagcacacggccctccaatcctcagtttacccatctgtcaaatggaggtaaccatgtctaagtggaggggtgctggggagacagaaggcgaagcgcacaggtcccacacccagcacagccccagggcctcggcagtcactgctgcaggcgctgcccacagcagcagctgctcccacgctgcatgctggccgctcgaccacccgcaagcaaacgagcacacacgatggccaggcgggagttg

SEQ ID NO: 1611 - DNA, 1140 bp, Homo sapiens
atgctcaagcgctgcggccggcgcctgctgctggcgctggcgggcgcgctgctcgcctgcctgctggtgctcaccgccgacccgccgccgcctccactgcccgccgagcgcggccggcgcgcgctgcgcagcctggcgggccccgcgggggctgccccggcgcccgggctgggggcggcggcggcggcgcccggggcgctggtccgcgacgtgcacagtctgtccgagtacttcagcctgctcacccgcgcgcgcagagatgcgggcccgccgcccggggctgccccccgccccgccgacggccacccgcgccccctggccgagccgctcgcgccccgagacgtcttcatcgctgtcaagaccaccaaaaagttccaccgcgcgcgcctcgacctgctgctggagacctggatctcgcgccacaaggagatgacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcagagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctag

SEQ ID NO: 1612 - DNA, 1140 bp, Homo sapiens; identical to SEQ ID NO: 1611

SEQ ID NO: 1613 - protein, 5 aa, Unknown
  cytokine receptor extracellular motif found in many species
  MISC_FEATURE (3)..(3): "Xaa" at position 3 can be any amino acid
WSXWS
